United States Patent 11,931,406 (FLAVIVIRUS VACCINE) - sequence listing, part 50

SEQ ID NO: 18303 - RNA, 9873 nt, Artificial Sequence
  derived and/or modified CDS sequence (opt4) from DENV-3__DQ675522__SS-prME
accagcuucugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagauguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgugggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccagcgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18304 - RNA, 9873 nt, Artificial Sequence
  derived and/or modified CDS sequence (opt4) from DENV-3__DQ675527__SS-prME
accagcuucugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagauguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgugggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaucaaccagauccuggaggagaacauggacguggagaucuggaccaaggagggcgagagaaagaaccugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccagcgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18305 - RNA, 9873 nt, Artificial Sequence
  derived and/or modified CDS sequence (opt4) from DENV-3__DQ675528__SS-prME
accagcuucugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgugcugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagauguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgugggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccagcgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18306 - RNA, 9873 nt, Artificial Sequence
  derived and/or modified CDS sequence (opt4) from DENV-3__DQ675530__SS-prME
accagcuucugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccccacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagauguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgugggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccagcgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18307 - RNA, 9873 nt, Artificial Sequence
  derived and/or modified CDS sequence (opt4) from DENV-3__DQ675533__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcacccacgaggcccugcugcccgaguacggcacccugggccuggagugcagccccagaaccggccuggacuucaacgagaugauccugcugaccaugaagaacaaggccuggauggugcacagacagugguucuucgaccugccccugcccugggccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacacccugggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagagcugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugcugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccugcugaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgaggugccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacaugguggugcccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucauccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugaccaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggagaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18308 - RNA, 9873 nt, Artificial Sequence
  derived and/or modified CDS sequence (opt4) from DENV-3__AY744677__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagagacugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18309 - RNA, 9873 nt, Artificial Sequence
  derived and/or modified CDS sequence (opt4) from DENV-3__AY744678__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccagcgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18310 - RNA, 9873 nt, Artificial Sequence
  derived and/or modified CDS sequence (opt4) from DENV-3__AY744679__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggccaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacaucaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaugaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugagcaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18311 - RNA, 9873 nt, Artificial Sequence
  derived and/or modified CDS sequence (opt4) from DENV-3__AY744680__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18312 - RNA, 9873 nt, Artificial Sequence
  derived and/or modified CDS sequence (opt4) from DENV-3__AY744681__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcagaaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcagcgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagaagacuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18313 - RNA, 9873 nt, Artificial Sequence
  derived and/or modified CDS sequence (opt4) from DENV-3__AY744682__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaccaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucagcggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaaccccuaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18314 - RNA, 9873 nt, Artificial Sequence
  derived and/or modified CDS sequence (opt4) from DENV-3__AY744683__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18315 - RNA, 9873 nt, Artificial Sequence
  derived and/or modified CDS sequence (opt4) from DENV-3__AY744684__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucagcacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18316 - RNA, 9873 nt, Artificial Sequence
  derived and/or modified CDS sequence (opt4) from DENV-3__AY744685__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagaugcagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacgccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgcccugagagccuggaacgugugggagguggaggacuacggcuucggcguguucaccaccaacaucuggcugaagcugagagagaaguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaucagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18317 - RNA, 9873 nt, Artificial Sequence
  derived and/or modified CDS sequence (opt4) from DENV-3__AY876494__SS-prME
accagccugugccugaugaugaugcugcccgccacccuggccuuccaccugaccagcagagacggcgagcccagaaugaucguggccaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacccguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccguggagaucaccccccaggccagcaccgccgaggccauccugcccgaguacggcacccuggugcuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuacuacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaccggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccccaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaaccugugggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccccuggcuggagcccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagaagcaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18318 - RNA, 9873 nt, Artificial Sequence
  derived and/or modified CDS sequence (opt4) from DENV-3__AY923865__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccggcagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagccccaggugggcaacgacacccagggcgugaccguggagaucaccccccaggccagcaccguggaggccgugcugcuggaguacggcacccugggccugaagugcagccccagaaccggccuggacuucaacgagaugauccugcugaccaugaagaccaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuuccuggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcaccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18319 - RNA, 9867 nt, Artificial Sequence
  derived and/or modified CDS sequence (opt4) from DENV-4__KR922405__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacaugguggacagaggcuggggcaacggcugcggccuguucggcaagggcggcguggugaccugcgccaaguucagcugccugggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaccaagaccuggcuggugcacaagcagugguuccuggaccugccccugcccuggaccaccggcgccgacacccuggaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcaccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggccugcuggugcuguggaucggcaccaacagcagaaacaccagcauggccaugagcugcaucgccgugggcggcaucacccuguuccugggcuucaccgugcacgccgacaugggcugcguggugagcuggagcggcaaggagcugaagugcggcagcggcaucuucgugaucgacaacgugcacaccuggaccgagcaguacaaguuccagcccgagagccccgccagacuggccagcgccauccugaacgcccacaaggagggcgugugcggcaucagaagcaccaccagacuggagaacgugauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgagaccagaaacagcaccuuccugguggacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccaucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugagcgccggccagggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcgacaccaugagcggcagaaugggcggccagauccaccuggccaucauggccguguucaagaugagccccggcuacgugcugggcaucuuccugagaaagcugaccagcagagagaccgcccugauggugaucggcauggccaugaccaccgugcugagcaucccccacgaccugauggaguucaucgacggcaucagccugggccugauccugcugaagauggugacccacuucgacaacacccaggugggcacccuggcccuggcccugaccuucaucaagagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacaccgagggcguguuccacaccauguggcacgugaccagaggcagcgugaucugccacgagagcggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcaccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccauguaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcuggugcccgagcccgagaagcagagaaccccccaggacaaccagcugaucuacgugauccugaccauccugaccaucaucgcccugguggccgccaacgagaugggccugaucgagaagaccaagaccgacuucggcuucuaccaggugaaggccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaaguucgccgugagcagaggcaccagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccgugcccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgugagcggcaacaucgugagcagcgugaacaccaccagcaagaugcugcugaacagauucaccaccagacacagaaagcccaccuacgagaaggacgccgaccugggcgccggcaccagaagcgugagcaccgagaccgagaagcccgacaugaccaucaucggcagaagacugcagagacugcaggaggagcacaaggagaccuggcacuacgaccacgagaaccccuacagaaccugggccuaccacggcagcuacgaggcccccagcaccggcagcgccagcagcauggugaacggcguggugaagcugcugaccaagcccugggacguggugcccauggugacccagcuggccaugaccgacaccacccccuucggccagcagagaguguucaaggagaagguggacaccagaaccccccagcccaagcccggcaccagagugaucaugaccaccaccgccaacuggcuguggacccugcugggcagaaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugagaagauacagcgcccacuucgagagcgagggcgugcuguga

SEQ ID NO: 18320 - RNA, 9867 nt, Artificial Sequence
  derived and/or modified CDS sequence (opt4) from DENV-4__KP188557__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccagaaucuucacccccgaggccagaaacaacaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugagaugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacgcccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18321 - RNA, 9867 nt, Artificial Sequence
  derived and/or modified CDS sequence (opt4) from DENV-4__KP188558__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacgacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaucagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18322 - RNA, 9867 nt, Artificial Sequence
  derived and/or modified CDS sequence (opt4) from DENV-4__KP188563__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucaucgccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacagagaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaucgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugagcgugaugaagagauacagcgcccccagcgagagcgagggcgugcuguga

SEQ ID NO: 18323 - RNA, 9867 nt, Artificial Sequence
  derived and/or modified CDS sequence (opt4) from DENV-4__KP188564__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccaucgcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaagaucaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccacccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccaacgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18324 - RNA, 9867 nt, Artificial Sequence
  derived and/or modified CDS sequence (opt4) from DENV-4__JN983813__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacaucagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18325 - RNA, 9867 nt, Artificial Sequence
  derived and/or modified CDS sequence (opt4) from DENV-4__KF041260__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccugauccagaucgagaaccuggaguacaccgugguggugaccgugcacaacggcgacacccacgccgugggcaacgacaccagcaaccacggcgugaccgccaccgugacccccagaagccccagcguggagguggagcugcccgacuacggcgagcugacccuggacugcgagcccagaagcggcaucgacuucaacgagaugauccugaugaagaugaacaagaagaccuggcuggugcacaagcagugguuccuggaccugccccugcccuggaccgccggcgccgacaccagcgaggugcacuggaaccacaaggagagaauggugaccuucaaggugccccacgccaagagacaggacgugaccgugcugggcagccaggagggcgccaugcacagcgcccugaccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggcuuccuggugcuguggaucggcaccaacagcagaaacaccagcauggccaugagcugcaucgccgugggcggcaucacccuguuccugggcuucaccgugcacgccgacaugggcugcgccgugagcuggagcggcaaggagcugaagugcggcagcggcaucuucaucaucgacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgagaccagaaacagcaccuuccugaucgacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccuucagccagcacaacuacagacagggcuacgccacccagaccaugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugagcgccggccagggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcaacaccaugagcagcagaaugggcggccagacccaccuggccaucauggccguguucaagaugagccccggcuacgugcugggcaucuuccugagaaagcugaccagcagagagaccgcccugauggugaucggcauggccaugaccaccgugcugagcaucccccacgaccugauggaguucaucgacggcaucagccugggccugauccugcugaagauggugacccacuucgacaacacccaggugggcacccuggcccugagccugaccuucaucaagagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaccgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccacccugaccgagggcguguacagaaucaugcagagaggccuguucggcaagacccaggugggcgugggcauccacauggagggcguguuccacaccauguggcacgugaccagaggcagcgugaucugccacgagagcggcagacuggagcccagcugggccgacgugaagaacgacaugaucagcuacggcggcggcuggagacugggcgacaagugggacaaggaggaggacgugcaggugcuggccguggagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagaccgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcaccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaagguggugcagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugaucaucaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacauccacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccguggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaugggcaagcugagcaugggccugaucgccaucgccguggccagcggccugcuguggguggccgagauccagccccaguggaucgccgccagcaucauccuggaguucuuccugauggcccugcugauccccgagcccgagaagcagagaaccccccaggacaaccagcugaucuacgugauccugaccauccugaccaucaucggccugguggccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacacccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaaguacgccgugagcagaggcaccagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcagccuggugagaugcccccugagcagaaacagcacccacgagauguacugggugagcggcgugagcggcaacaucgugagcagcgugaacaccaccagcaagaugcugcugaacagauucaccaccagauacagaaagcccaccuacgagaaggacgccgaccugggcgccggcaccagaagcgugagcaccgagaccgagaagcccgacauggccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucaccagagacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccuucgagagcgagggcgugcuguga

SEQ ID NO: 18326 - RNA, 9867 nt, Artificial Sequence
  derived and/or modified CDS sequence (opt4) from DENV-4__FJ024476__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccgccaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaugaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggccugcuggugcuguggaucggcaccaacagcagaaacaccagcauggccaugaccugcaucgccgugggcggcaucacccuguuccugggcuucaccgugcaggccgacaugggcugcguggugagcuggagcggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccagaaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccaugggccccuggcaccugggcaagcuggagaucggcuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagagagaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaagguggugcagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugagagagagaguggagaaguggcugaaggagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18327 - RNA, 9867 nt, Artificial Sequence
  derived and/or modified CDS sequence (opt4) from DENV-4__GQ868579__SS-prME
agcaccaucacccugcugugccugauccccaccaucauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcugaucaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugagagccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagagcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacagagaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaccuuccuguucuucaugcagggcaagggcaucggcaagcugagcaugggccugaucaccaucgccauggccagcggccugcuguggaucgccgagauccagccccaguggaucgccgccagcaucauccuggaguucuuccugauggugcugcugauccccgagcccgagaagcagagaaccccccaggacaaccagcugaucuacgugauccugaccauccuggccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccaggcccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaacuggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18328 - RNA, 9867 nt, Artificial Sequence
  derived and/or modified CDS sequence (opt4) from DENV-4__GQ868580__SS-prME
agcaccaucacccugcugugccugauccccaccaucauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcugaucaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugaccgccggccagagcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccaccuucagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccugcugggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacagagaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccauggccagcggccugcuguggaucgccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugagcgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacagccugaacaccuucaccaacauggaggugcagcugaucagacagauggaggccgagggcgugaucacccaggacgacaugcagaaccccaagggccugaaggagagaguggagaacuggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18329 - RNA, 9867 nt, Artificial Sequence
  derived and/or modified CDS sequence (opt4) from DENV-4__GQ868583__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucaugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccuggccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugcaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugagcgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18330 - RNA, 9867 nt, Artificial Sequence
  derived and/or modified CDS sequence (opt4) from DENV-4__GQ868584__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggacagacaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucaugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccuggccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugagcgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18331 - RNA, 9867 nt, Artificial Sequence
  derived and/or modified CDS sequence (opt4) from DENV-4__GQ868585__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacgagaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugaucgaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18332 - RNA, 9867 nt, Artificial Sequence
  derived and/or modified CDS sequence (opt4) from DENV-4__JQ922560__SS-prME
agcaccaucacccugcugugccugauccccaccgugauggccuuccaccugagcaccagagacggcgagccccugaugaucguggccaagcacgagagaggcagaagacugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcaccggcaagaucaccggcaaccugauccagaucgagaaccuggaguacaccgugguggugaccgugcacaacggcgacacccacgccgugggcaacgacaccagcaaccacggcgugaccgccaccaucacccccagaagccccagcguggagguggagcugcccgacuacggcgagcugacccuggacugcgagcccagaagcggcaucgacuucaacgagaugauccugaugaagaugaacaagaagaccuggcuggugcacaagcagugguuccuggaccugccccugcccugggccgccggcgccgacaccagcgaggugcacuggaaccacaaggagagaauggugaccuucaaggugccccacgccaagagacaggacgugaccgugcugggcagccaggagggcgccaugcacagcgcccugaccggcgccaccgagguguacagcggcgacggcaaccugauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcacccccuucgccgagaacaccaacagcgugaccaacaucgagcuggagccccccuucggcgacagcuacaucgugaucggcgugggcgacagcgcccugacccugcacugguucaccaagggcagcagcaucggcaagauguucgagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggcuuccuggugcuguggaucggcaccaacagcagaaacaccagcauggccaugagcugcaucgccgugggcggcaucacccuguuccugggcuucaccgugcacgccgacaugggcugcgccgugagcuggagcggcaaggagcugaagugcggcagcggcaucuucaucaucgacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgagaccagaaacagcaccuuccugaucgacggccccgacaccagcgagugccccaacgagagaagagccuggaacuuccuggagguggaggacuacggcuucggcauguucaccaccaacaucuggaugaaguucagagagggcagcagcgagaugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugagcgccggccagggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcaacaccaugagcagcagaaugggcggccagauccaccuggccaucauggccguguucaagaugagccccggcuacgugcugggcaucuuccugagaaagcugaccagcagagagaccgcccugauggugaucggcauggccaugaccaccgugcugagcaucccccacgaccugauggaguucguggacggcaucagccugggccugauccugcugaagauggugacccacuucgacaacacccaggugggcacccuggcccugagccugaccuucaucaagagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaccgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacauggagggcguguuccacaccauguggcacgugaccagaggcagcgugaucugccacgagagcggcagacuggagcccagcugggccgacgugagaaacgacaugaucagcuacggcggcggcuggagacugggcgacaagugggacaaggaggaggacgugcaggugcuggccguggagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcaccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaagguggugcagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugaucaucaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccguggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugaucgcccugcugggcgccaugaccgccggcaucuuccuguucuucaugcagggcaagggcaugggcaagcugagcaugggccugaucgccaucgccguggccagcggccugcuguggguggccgagauccagccccaguggaucgccgccagcaucauccuggaguucuuccugauggcccugcugauccccgagcccgagaagcagagaaccccccaggacaaccagcugaucuacgugauccugaccauccugaccaucaucggccugguggccgccaacgagaugggccugaucgagaagaccaagaccgacuucggcuucuaccaggagaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacacccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaaguacgccgugagcagaggcaccagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcagccuggugagaugcccccugagcagaaacagcacccacgagauguacugggugagcggcgugagcagaaacaucgugagcagcgugaacaccaccagcaagaugcugcugaacagauucaccaccagauacagaaagcccaccuacgagaaggacgccgaccugggcgccggcaccagaagcgugagcaccgagaccgagaagcccgacauggccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacguggugcccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagaaccccagacugugcaccagagaggaguucaucagcaaggugagaagcaacgccgccaucggcgccgugagccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucaccagagacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaucgaggaguacguggacuacaugcccgugaugaagagauacagcgcccccuucgagagcgagggcgugcuguga

SEQ ID NO: 18333 - RNA, 9867 nt, Artificial Sequence
  derived and/or modified CDS sequence (opt4) from DENV-4__JQ922558__SS-prME
agcacccugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugccugggcaagaucaccggcaaccuggugcagaucgagaaccuggaguacaccgugguggugaccgugcacaacggcgacacccacgccgugggcaacgacaucagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugggugcuggaccugccccugcccugggccgccggcgccgacaccagcaaggugcaguggaacuacaaggagagaauggugaccuucaaggugccccacgccaagagacaggacgugaccgugcugggcagccaggagggcgccaugcacagcgcccugaccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagcacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggauggugagaauccugaucggccugcuggugcuguggaucggcaccaacagcagaaacaccagcauggccaugaccugcaucgccaucggcggcaucacccuguuccugggcuucaccgugcacgccgacaugggcugcgccgugagcuggagcggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagcccuggcagaucggcaacgccagccugaucgaggugaagaccugccuguggcccaagacccacacccuguggagcaacggcgugcuggagagccagaugcugauccccaaggccuacgccggccccuucagccagcacaacuacagacagggcuacgccacccagaccaucggccccuggcaccugggcaagcuggagaucgacuucggcgagugccccggcaccaccgugaccauccaggaggacugcaaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugagcgccggccagggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcgacaccaugagcggcagaaugggcggccagauccaccugaccaucauggccguguucaagaugagccccggcuacgugcugggcguguuccugagaaagcugaccagcagagagaccgcccugaucgugaucggcauggccaugaccaccgugcugagcaucccccacgaccugauggaguucaucgacggcaucagccugggccugauccugcugaagaugguggcccacuucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcacugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgaccccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccgccaacccccugagcagcaccagagugcccaacuacaaccugaucgugauggacgaggcccaccugcaggaccugagcaucguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccagaagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagauccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugauggccaucgccguggccagcggccugcuguggguggccgagauccagccccaguggaucgccgccagcaucauccuggaguucuucagcauggcccugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugagcgugcacuacgccaucaucggccccggccugcaggccaaggccaccagagaggcccagaagagaagcgccgccggcaucaugaagaaccccaccguggacggcaucaccgugaucgaccuggagcccaucagcuacgaccccaaguucgagaagcagcugggccaggugaugcugcuggcccugugcgccggccagcugcugcugaugagaaccaccugggccuucugcgaggugcugacccuggccaccggccccauccugacccugugggagggcaaccccggcagauucuggaacaccaccauccccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcaucuucgagguggacagacacgagaucaaguacacccugaaggacggcagcaagaucaaccacgccaugagcaccggcagcaucaagaucagaggcaucgacgagagaggcauggugaagcccaagggcaaggugguggaccagggcugcggcagaggcggcuggagccacuacaccgccaccgccaagaaggugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcagccuggugagaugcccccugagcagaaacagcacccacgagauguacugggugagcggcgugagcggcaacaucgugagcagcgugaacaccaccagcaagaugcugcugaacagauucaccaccagacacagaaagcccaccuacgagaaggacguggaccugggcgccggcaccagaagcgugagcaucgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagagaguucaaggagaagguguacaccagcaccccccaccccaagcccuggaccagaauggugaugaccaccaccgccaacuggcugugggcccugggcggcaagaagaagagccccagacugugcaccugggaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacagaauccuggccaaggccaucuucaagcugaccuaccacagcaaggugaugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacgugcccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccaucgagagcgagggcgugcuguga

SEQ ID NO: 18334 - RNA, 9867 nt, Artificial Sequence
  derived and/or modified CDS sequence (opt4) from DENV-4__JQ922559__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaucagcauccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcaguggaacuacaaggagagaauggugaccuucaaggugccccacgccaagagacaggacgugaccgugcugggcagccaggagggcgccaugcacagcgcccugaccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccuacagcgugaccaacaucgagcuggagccccccuucggcgacagcuacaucaucaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggccugcuggugcuguggaucggcaccaacagcagaaacaccagcauggccaugagcugcaucgccgugggcggcaucacccuguuccugggcuucaccgugcacgccgacaugggcugcgccgugagcuggagcggcaaggagcugaagugcggcagcggcaucuucgugaucgacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccaucguggccggcgacgugaagggcgugcugagcaagggcaagagagcccuggccccccccgugaacgaccugaaguacagcuggaagaccuggggcaaggccaagaucuucacccccgagaccagaaacagcaccuuccugaucgacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagagagaggagaacauggugaagagccaggugagcgccggccagggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcgacaccaugagcagcagaaugggcggccagauccaccuggccaucauggccguguucaagaugagccccggcuacgugcugggcaucuuccugagaaagcugaccagcagagagaccgcccugauggugaucggcauggccaugaccaccgugcugagcaucccccacgaccugauggaguucaucgacggcaucagccugggccugauccugcugaagauggugacccacuucgacaacacccagaugggcacccuggcccugagccugaccuucaucaagagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacauggagggcguguuccacaccauguggcacgugaccagaggcagcgugaucugccacgagagcggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugcugagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcaccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgugaugggcgccaacuucagagccggcagagugaucgaccccagaagaugccugaagcccgugaucaucaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaucggcgagcugagcaugggccugaucgccaucgccggcgccagcggccugcuguggggcaccaagacccccccccccuggggcgccgccagcaacauccuggaguucuuccugauggugcugcugauccccgagcccgagaagcagagaaccccccaggacaaccagcugaucuacgugauccugaccauccugaccaucaucggccugguggccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaucgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcgugaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcaggccgugagcagaggcaccagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcagaguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcagccuggugagaugcccccugagcagaaacagcacccacgagauguacugggugagcggcgugagcggcaacaucgugagcagcgugaacaccaccagcaagaugcugcugaacagauucaccaccaagcacagaaagcccaccuacgagaaggacgccgaccugggcgccggcaccagaagcgugagcaccgagaccgagaagcccgacaugaccaucaucggcagaagacugcagagacugcaggaggagcaccaggagaccuggcacuacgaccaggagaaccccuacagaaccugggccuaccacggcggcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccgugagccaggaggagcagggcuggaccagcagcuucgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggaccuggacaagagagacagaagccugguguucgccgacgacaccgccggcugggacaccaagauccccgaggacgaccugcugaaggagaagcccauccccggccccauggccccccaccagagaauccccgccagagccaucuucaagcugaccuaccagaacaagguggugaaggugcugagacugaagcugaagggcgccgugauggacaucaucagcagaaaggagcagagaggcagcggccaggugggcaccuacggccugaacaccuucaccaacauggaggugcagcugaucagacagauggaggccgagggcgugaucaccagagacgacaugcacaaccccaagggccugaaggagagaguggagaaguggcugaaggagugcggcguggacagacuggagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaucgagggcuacguggacuacuuccugcugaucaagugguacagcgcccccuucgagagcgagggcgugcuguga

SEQ ID NO: 18335 - RNA, 9867 nt, Artificial Sequence
  derived and/or modified CDS sequence (opt4) from DENV-4__KF955510__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagaaccgagaccuggaugagcagcgagggcgccuggaagcacgcccagagaguggagagcuggauccugagaaagcccggcuucgcccugagcgccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacaugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgagaccgccaccaucacccccagaagccccagcguggaggugagacugcccgacuacggcgagcugacccuggacugcgagcccagaagcggcaucgacuucaacgagaugauccugaugaagaugaagaccaagaccuggcuggugcacaagcagugguuccuggaccugccccugcccuggaccgccggcgccgacaccagcgaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcaccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgccggcgacagcgcccugacccugcacugguucagaaagggcagcagcaucggcaagauguucgagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggccugcuggugcuguggaucggcaccaacagcagaaacaccagcauggccaugagcugcaucguggugggcggcaucacccuguuccugggcuucaccgugcacgccgacaugggcugcguggugagcuggagcggcaaggagcugaagugcggcagcggcaucuucgugaucgacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgagaccagaaacagcaccuuccugguggacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccaucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugagcgccggccagggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcgacaccaugagcggcagaaugggcggccagauccaccuggccaucauggccauguucaagaugagccccggcuacgugcugggcaucuuccugagaaagcugaccagcagagagaccgcccugauggugaucggcauggccaugaccaccgugcugagcaucccccacgaccugauggaguucaucgacggcaucagccugggccugauccugcugaagauggugacccacuucgacaacacccaggugggcacccuggcccugagccugaccuucaucaagagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcgccuacagaaucaugcagagaggccuguucggcaagacccaggugggcgugggcauccacauggagggcguguuccacaccauguggcacgugaccagaggcagcgugaucugccacgagagcggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcaccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaugggcaagcugagcaugggccugaucgccaucgccguggccagcggccugcuguggguggccgagauccagccccaguggaucgccgccagcaucauccuggaguucuuccugauggugcugcuggugcccgagcccgagaagcagagaaccccccaggacaaccagcugaucuacgugauccugaccauccugaccaucaucgcccugguggccgccaacgagaugggccugaucgagaagaccaagaccgacuucggcuucuaccaggccaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaagggcuucgaggaguacaagagaagcggcauccuggagguggacagaaccgaggccaagagcgcccugaaggacggcagcaagaucaaguacgccgugagcagaggcaccagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcagccuggugagaugcccccugagcagaaacagcacccacgagauguacugggugagcggcgugagcggcaacaucgugagcagcgugaacaccaccagcaagaugcugcugaacagauucaccaccagacacagaaagcccaccuacgagaaggacgccgaccugggcgccggcaccagaagcgugagcaccgagaccgagaagcccgacaugaccaucaucggcagaagacugcagagacugcaggaggagcacaaggagaccuggcacuacgaccacgagaaccccuacagaaccugggccuaccacggcagcuacgaggcccccagcaccggcagcgccagcagcauggugaacggcguggugaagcugcugaccaagcccugggacguggugcccauggugacccagcuggccaugaccgacaccacccccuucggccagcagagaguguucaaggagaagguggacaccagaaccccccagcccaagcccggcaccagaguggugaugaccaccaccgccaacuggcugugggcccugcugggcagaaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucaccagagacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccacuucgagagcgagggcgugcuguga

SEQ ID NO: 18336 - RNA, 9867 nt, Artificial Sequence
  derived and/or modified CDS sequence (opt4) from DENV-4__GQ868594__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacgagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacauccccaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccugggccgccggcgccgacaccagcgaggugcacuggaacuacaaggagagaauggugaccuucaaggugccccacgccaagagacaggacgugaucgugcugggcagccaggagggcgccaugcacagcgcccugaccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgaguacaccaacagcgugaccaacaucgagcuggagccccccuucggcgacagcuacaucgugaucggcgugggcgacagcgcccugacccugcacugguucagaaagggcagcagcaucggcaagaugcuggagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggcuuccuggugcuguggaucggcaccaacagcagaaacaccagcauggccaugaccugcaucgccgugggcggcaucacccuguuccugggcuucaccgugcacgccgacaccggcugcgccgugagcuggagcggcaaggagcugaagugcggcagcggcaucuucgugaucgacaacgugcacaccuggaccgagcaguacaaguuccagcccgagagccccgccagacuggccagcgccauccugaacgcccacaaggacggcgugugcggcaucagaagcaccaccagacuggagaacaucauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgaggccaagaacagcaccuuccugaucgacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugagcgccggccagggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcgacaccaugagcggcagaaugggcggccagauccaccuggccaucauggccguguucaagaugagccccggcuacgugcugggcaucuuccugagaaagcugaccagcagagagaccgcccugauggugaucggcauggccaugaccaccgugcugagcaucccccacgaccugauggaguucaucgacggcaucagccugggccugauccugcugaagauggugacccacuucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacaucgaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaccggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugaucagcaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagaaccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaucgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccgugcugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcagccuggugagaugcccccugagcagaaacagcacccacgagauguacugggugagcggcgugagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccuucgagagcgagggcgugcuguga

SEQ ID NO: 18337 - RNA, 9867 nt, Artificial Sequence
  derived and/or modified CDS sequence (opt4) from DENV-4__FJ024424__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccaccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccacccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacaugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18338 - RNA, 9867 nt, Artificial Sequence
  derived and/or modified CDS sequence (opt4) from DENV-4__EU854295__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccccggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaguggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18339 - RNA, 9867 nt, Artificial Sequence
  derived and/or modified CDS sequence (opt4) from DENV-4__EU854296__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgccaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggccaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaucggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacagacccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18340 - RNA, 9867 nt, Artificial Sequence
  derived and/or modified CDS sequence (opt4) from DENV-4__GQ199878__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18341 - RNA, 9867 nt, Artificial Sequence
  derived and/or modified CDS sequence (opt4) from DENV-4__GQ199879__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggauggugagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaccaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccauccacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18342 - RNA, 9867 nt, Artificial Sequence
  derived and/or modified CDS sequence (opt4) from DENV-4__GQ199880__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaccaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccauccacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18343 - RNA, 9867 nt, Artificial Sequence
  derived and/or modified CDS sequence (opt4) from DENV-4__GQ252675__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaagaucagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugaccgccggccagggcaccagcgagaccuucagcaugggccugcugugccugacccuguucguggaggagugccugagaagaagagugaccagaaagcacaugaugcuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaccgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaccaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccauccacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18344 - RNA, 9867 nt, Artificial Sequence
  derived and/or modified CDS sequence (opt4) from DENV-4__FJ810417__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaucccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaccaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccauccacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18345 - RNA, 9867 nt, Artificial Sequence
  derived and/or modified CDS sequence (opt4) from DENV-4__FJ850057__SS-prME
agcaccaucacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccacccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaccaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccauccacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18346 - RNA, 9867 nt, Artificial Sequence
  derived and/or modified CDS sequence (opt4) from DENV-4__GQ199881__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccagaauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucuucaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaugauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcagcagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccuggccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18347 - RNA, 9867 nt, Artificial Sequence
  derived and/or modified CDS sequence (opt4) from DENV-4__GQ199882__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggcagcgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18348 - RNA, 9867 nt, Artificial Sequence
  derived and/or modified CDS sequence (opt4) from DENV-4__GQ199883__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcgccgaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccuggccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18349 - RNA, 9867 nt, Artificial Sequence
  derived and/or modified CDS sequence (opt4) from DENV-4__GQ199884__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccuggccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18350 - RNA, 9867 nt, Artificial Sequence
  derived and/or modified CDS sequence (opt4) from DENV-4__FJ882595__SS-prME
agcaccaucacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaccggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18351 - RNA, 9867 nt, Artificial Sequence
  derived and/or modified CDS sequence (opt4) from DENV-4__FJ882596__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugagaggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18352 - RNA, 9867 nt, Artificial Sequence
  derived and/or modified CDS sequence (opt4) from DENV-4__FJ850059__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcguguggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaucgcccacaaggacggcgugugcggcaucagaagcaccaccagacuggagaacgugauguggaagcagaucaccaacgagcugaacuacgugcugugggagggcggccacgaccugaccgugguggccggcgacgccaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacagacccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18353 - RNA, 9867 nt, Artificial Sequence
  derived and/or modified CDS sequence (opt4) from DENV-4__FJ882598__SS-prME
agcaccaucacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18354 - RNA, 9867 nt, Artificial Sequence
  derived and/or modified CDS sequence (opt4) from DENV-4__FJ882601__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucgugaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccuggccauccugaccaucaucggccugaucgccgccaacgagaugggccugaucgagaagaccaagaccgacuucggcuucuaccaggagaagaccgagaccaccauccuggacguggaccugagacccgccagcgccuggacccuguacgccguggccaccaccauccugacccccaugcugagacacaccaucgagaacaccagcgccaaccugagccugaccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccugaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgugcagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcuggugaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18355 - RNA, 9867 nt, Artificial Sequence
  derived and/or modified CDS sequence (opt4) from DENV-4__FJ226067__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaagaggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucaccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgcccugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccugagcgagagcgagggcgugcuguga

SEQ ID NO: 18356 - RNA, 9867 nt, Artificial Sequence
  derived and/or modified CDS sequence (opt4) from DENV-4__EU854299__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18357 - RNA, 9867 nt, Artificial Sequence
  derived and/or modified CDS sequence (opt4) from DENV-4__FJ182016__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugagaggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacagaaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18358 - RNA, 9867 nt, Artificial Sequence
  derived and/or modified CDS sequence (opt4) from DENV-4__EU854300__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgagaccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacaucgagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccuggcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaaggccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18359 - RNA, 9867 nt, Artificial Sequence
  derived and/or modified CDS sequence (opt4) from DENV-4__FJ182017__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggcccugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18360 - RNA, 9867 nt, Artificial Sequence
  derived and/or modified CDS sequence (opt4) from DENV-4__EU854301__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagaucuucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaugggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcuguuccugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccagcgagagcgagggcgugcuguga

SEQ ID NO: 18361 - RNA, 9867 nt, Artificial Sequence
  derived and/or modified CDS sequence (opt4) from DENV-4__FJ639736__SS-prME
agcaccaugacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18362 - RNA, 9867 nt, Artificial Sequence
  derived and/or modified CDS sequence (opt4) from DENV-4__FJ639737__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcugaucaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacgacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccagcgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacaucgagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaucgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18363 - RNA, 9867 nt, Artificial Sequence
  derived and/or modified CDS sequence (opt4) from DENV-4__FJ639738__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaagacugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccguggagcccggcaagaaccccaagcacgugcagaccaagcccggccuguucaagaccaucaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18364 - RNA, 9867 nt, Artificial Sequence
  derived and/or modified CDS sequence (opt4) from DENV-4__FJ639739__SS-prME
agcaccaugacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccuggccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaagaucguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgaguggcugcccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18365 - RNA, 9867 nt, Artificial Sequence
  derived and/or modified CDS sequence (opt4) from DENV-4__JN819409__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccgccaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacggcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccgugaucaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccaaggaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccauccacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18366 - RNA, 9867 nt, Artificial Sequence
  derived and/or modified CDS sequence (opt4) from DENV-4__FJ639742__SS-prME
agcaccaugacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacauggugggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccagcgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18367 - RNA, 9867 nt, Artificial Sequence
  derived and/or modified CDS sequence (opt4) from DENV-4__FJ639745__SS-prME
agcaccaugacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggccugcuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucgccaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18368 - RNA, 9867 nt, Artificial Sequence
  derived and/or modified CDS sequence (opt4) from DENV-4__FJ850095__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18369 - RNA, 9867 nt, Artificial Sequence
  derived and/or modified CDS sequence (opt4) from DENV-4__FJ639748__SS-prME
agcaccaugacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugcagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggccugcuggugcuguggaucggcaccaacagcagaaacaccagcauggccaugaccugcaucgccgugggcggcaucacccuguuccugggcuucaccgugcaggccgacgugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagagcaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucgccaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagaacgagggcgugcuguga

SEQ ID NO: 18370 - RNA, 9867 nt, Artificial Sequence
  derived and/or modified CDS sequence (opt4) from DENV-4__FJ639764__SS-prME
agcaccaucacccugcugugccugauccccaccgugauggccuuccaccugagcaccagagacggcgagccccugaugaucguggccaagcacgagagaggcagaccccugcuguucaagaccaccgagggcaccaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaucgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagaacccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaagacugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccguggagcccggcaagaaccccaagcacgugcagaccaagcccggccuguucaagaccaucaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18371 - RNA, 9867 nt, Artificial Sequence
  derived and/or modified CDS sequence (opt4) from DENV-4__FJ639773__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagagacugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccaccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggagaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18372 - RNA, 9867 nt, Artificial Sequence
  derived and/or modified CDS sequence (opt4) from DENV-4__FJ882580__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagagaguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccaucguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18373 - RNA, 9867 nt, Artificial Sequence
  derived and/or modified CDS sequence (opt4) from DENV-4__FJ882581__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccuggcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18374 - RNA, 9867 nt, Artificial Sequence
  derived and/or modified CDS sequence (opt4) from DENV-4__FJ882582__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccuggcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacgccgacuacaugcccgugaugaagagauacagcgcccccagcgagagcgagggcgugcuguga

SEQ ID NO: 18375 - RNA, 9867 nt, Artificial Sequence
  derived and/or modified CDS sequence (opt4) from DENV-4__FJ882584__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18376 - RNA, 9867 nt, Artificial Sequence
  derived and/or modified CDS sequence (opt4) from DENV-4__FJ882585__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaccauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgccaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaccacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccaaggaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18377 - RNA, 9867 nt, Artificial Sequence
  derived and/or modified CDS sequence (opt4) from DENV-4__FJ882586__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucgcccaggugagaaaccugaucggcaaggaggaguacguggacuacaugcccgugaugaagagauacagcgcccccagcgagagcgagggcgugcuguga

SEQ ID NO: 18378 - RNA, 9867 nt, Artificial Sequence
  derived and/or modified CDS sequence (opt4) from DENV-4__JN819406__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcgccagagagcugaagugcggcagcggcaucuucgugguggacaacgugcacaccuggaccgagcaguaccaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18379 - RNA, 9867 nt, Artificial Sequence
  derived and/or modified CDS sequence (opt4) from DENV-4__GQ199876__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaaggugaucggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccgugagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18380 - RNA, 9867 nt, Artificial Sequence
  derived and/or modified CDS sequence (opt4) from DENV-4__KP723482__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcaacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucaccuucugcgccaucauccugggcggccugaccuggauggaccugcugagagugcugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacguguggcaggugaagacccagagaagcggcgcccugugggacgugcccagccccagcgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagcccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccgugaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcaccaagaucaaguacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccgugaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccuucgagagcgagggcgugcuguga

SEQ ID NO: 18381 - RNA, 9867 nt, Artificial Sequence
  derived and/or modified CDS sequence (opt4) from DENV-4__JN638570__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacaugguggacagaggcuggggcaacggcugcggccuguucggcaagggcggcguggugaccugcgccaaguucagcugccugggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaccaagaccuggcuggugcacaagcagugguuccuggaccugccccugcccuggaccaccggcgccgacacccuggaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcaccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacggcgcccugacccugcacugguucagaaagggcagcagcaucggcaagauguucgagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggccugcuggugcuguggaucggcaccaacagcagaaacaccagcauggccaugagcugcaucgccgugggcggcaucacccuguuccugggcuucaccgugcacgccgacaugggcugcguggugagcuggagcggcaaggagcugaagugcggcagcggcaucuucgugaucgacaacgugcacaccuggaccgagcaguacaaguuccagcccgagagccccgccagacuggccagcgccauccugaacgcccacaaggagggcgugugcggcaucagaagcaccaccagacuggagaacgugauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgagaccagaaacagcaccuuccugguggacggccccgacaccagcgagugccccaacgagagaagagccuggaacuuccuggagguggaggacuacggcuucggcauguucaccaccaacaucuggaugaaguucagagagggcagccccgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccaucagccagcacaacuacagacagggcuacgccacccagaccgccggccccuggcaccugggcaagcuggagaucgacuucggcgagugccccggcaccaccgugaccgugcaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugagcgccggccagggcaccagcgagaccuucagcaugggccugcugugccugacccuguucguggaggagugccugagaagaagagugaccagaaagcacaugaugcuggugguggugaccacccugugcgccaucauccugggcggccugaccuggauggaccugcugagagcccugaucaugcugggcgacaccaugagcggcagaaugggcggccagauccaccuggccaucauggccguguucaagaugagccccggcuacgugcugggcaucuuccugagaaagcugaccagcagagagaccgcccugauggugaucggcauggccaugaccaccgugcuggccaucccccacgaccugauggaguucaucgacggcaucagccugggccugauccugcugaagauggugacccacuucgacaacacccaggugggcacccuggcccuggcccugaccuucaucaagagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugagaugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacaccgagggcguguuccacaccauguggcacgugaccagaggcagcgugaucugccacgagagcggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcaccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcuggugcccgagcccgagaagcagagaaccccccaggacaaccagcugaucuacgugauccugaccauccugaccaucaucgcccugguggccgccaacgagaugggccugaucgagaagaccaagaccgacuucggcuucuaccaggugaaggccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaaguacgccgugagcagaggcaccagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagauacggcggcagccuggugagaugcccccugagcagaaacagcacccacgagauguacugggugagcggcgugagcggcaacaucgugagcagcgugaacaccaccagcaagaugcugcugaacagauucaccaccagacacagaaagcccaccuacgagagagacgccgaccugggcgccggcaccagaagcgugagcaccgagaccgagaagcccgacaugaccaucaucggcagaagacugcagagacugcaggaggagcacaaggagaccuggcacuacgaccacgagaaccccuacagaaccugggccuaccacggcagcuacgaggcccccagcaccggcagcgccagcagcauggugaacggcguggugaagcugcugaccaagcccugggacguggugcccauggugacccagcuggccaugaccgacaccacccccuucggccagcagagaguguucaaggagaagguggacaccagaaccccccagcccaagcccggcaccagaguggugaugaccaccaccgccaacuggcuguggacccugcugggcagaaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucaccagagacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugagaagauacagcgcccacuucgagagcgagggcgugcuguga

SEQ ID NO: 18382 - RNA, 9867 nt, Artificial Sequence
  derived and/or modified CDS sequence (opt4) from DENV-4__JN638571__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacaugguggacagaggcuggggcaacggcugcggccuguucggcaagggcggcguggugaccugcgccaaguucagcugccugggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgaguacggcgagcugacccuggacugcgagcccagaagcggcaucgacuucaacgagaugauccugaugaagaugaagaccaagaccuggcuggugcacaagcagugguuccuggaccugccccugcccuggaccaccggcgccgacacccuggaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcaccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacggcgcccugacccugcacugguucagaaagggcagcagcaucggcaagauguucgagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggccugcuggugcuguggaucggcaccaacagcagaaacaccagcauggccaugagcugcaucgccgugggcggcaucacccuguuccugggcuucaccgugcacgccgacaugggcugcguggugagcuggagcggcaaggagcugaagugcggcagcggcaucuucgugaucgacaacgugcacaccuggaccgagcaguacaaguuccagcccgagagccccgccagacuggccagcgccauccugaacgcccacaaggagggcgugugcggcaucagaagcaccaccagacuggagaacgugauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgagaccagaaacagcaccuuccugguggacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccaucagccagcacaacuacagacagggcuacgccacccagaccgccggccccuggcaccugggcaagcuggagaucgacuucggcgagugccccggcaccaccgugaccgugcaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugagcgccggccagggcaccagcgagaccuucagcaugggccugcugugccugacccuguucguggaggagugccugagaagaagagugaccagaaagcacaugaugcuggugguggugaccacccugugcgccaucauccugggcggccugaccuggauggaccugcugagagcccugaucaugcugggcgacaccaugagcggcagaaugggcggccagauccaccuggccaucauggccguguucaagaugagccccggcuacgugcugggcaucuuccugagaaagcugaccagcagagagaccgcccugauggugaucggcauggccaugaccaccgugcuggccaucccccacgaccugauggaguucaucgacggcaucagccugggccugauccugcugaagauggugacccacuucgacaacacccaggugggcacccuggcccuggcccugaccuucaucaagagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugagaugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacaccgagggcguguuccacaccauguggcacgugaccagaggcagcgugaucugccacgagagcggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcaccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcuggugcccgagcccgagaagcagagaaccccccaggacaaccagcugaucuacgugauccugaccauccugaccaucaucgcccugguggccgccaacgagaugggccugaucgagaagaccaagaccgacuucggcuucuaccaggugaaggccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaaguacgccgugagcagaggcaccagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagauacggcggcagccuggugagaugcccccugagcagaaacagcacccacgagauguacugggugagcggcgugagcggcaacaucgugagcagcgugaacaccaccagcaagaugcugcugaacagauucaccaccagacacagaaagcccaccuacgagagagacgccgaccugggcgccggcaccagaagcgugagcaccgagaccgagaagcccgacaugaccaucaucggcagaagacugcagagacugcaggaggagcacaaggagaccuggcacuacgaccacgagaaccccuacagaaccugggccuaccacggcagcuacgaggcccccagcaccggcagcgccagcagcauggugaacggcguggugaagcugcugaccaagcccugggacguggugcccauggugacccagcuggccaugaccgacaccacccccuucggccagcagagaguguucaaggagaagguggacaccagaaccccccagcccaagcccggcaccagaguggugaugaccaccaccgccaacuggcuguggacccugcugggcagaaagaagaaccccagacugugcaccagagaggaguucaucagcaaggugagacugaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucaccagagacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugagaagauacagcgcccacuucgagagcgagggcgugcuguga

SEQ ID NO: 18383 - RNA, 9867 nt, Artificial Sequence
  derived and/or modified CDS sequence (opt4) from DENV-4__JN638572__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacaugguggacagaggcuggggcaacggcugcggccuguucggcaagggcggcguggugaccugcgccaaguucagcugccugggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgaguacggcgagcugacccuggacugcgagcccagaagcggcaucgacuucaacgagaugauccugaugaagaugaagaccaagaccuggcuggugcacaagcagugguuccuggaccugccccugcccuggaccaccggcgccgacacccuggaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcaccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacggcgcccugacccugcacugguucagaaagggcagcagcaucggcaagauguucgagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggccugcuggugcuguggaucggcaccaacagcagaaacaccagcauggccaugagcugcaucgccgugggcggcaucacccuguuccugggcuucaccgugcacgccgacaugggcugcguggugagcuggagcggcaaggagcugaagugcggcagcggcguguucgugaucgacaacgugcacaccuggaccgagcaguacaaguuccagcccgagagccccgccagacuggccagcgccauccugaacgcccacaaggagggcgugugcggcaucagaagcaccaccagacuggagaacgugauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgagaccagaaacagcaccuuccugguggacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccaucagccagcacaacuacagacagggcuacgccacccagaccgccggccccuggcaccugggcaagcuggagaucgacuucggcgagugccccggcaccaccgugaccgugcaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugagcgccggccagggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcgacaccaugagcggcagaaugggcggccagauccaccuggccaucauggccguguucaagaugagccccggcuacgugcugggcaucuuccugagaaagcugaccagcagagagaccgcccugauggugaucggcauggccaugaccaccgugcuggccaucccccacgaccugauggaguucaucgacggcaucagccugggccugauccugcugaagauggugacccacuucgacaacacccaggugggcacccuggcccuggcccugaccuucaucaagagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugagaugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacaccgagggcguguuccacaccauguggcacgugaccagaggcagcgugaucugccacgagagcggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcaccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcuggugcccgagcccgagaagcagagaaccccccaggacaaccagcugaucuacgugauccugaccauccugaccaucaucgcccugguggccgccaacgagaugggccugaucgagaagaccaagaccgacuucggcuucuaccaggugaaggccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaccaagcacgccgugagcagaggcagcagcaagaucagauggaucguggagagaggcaugaucaagcccaagggcaaggugguggaccugggcugcggcagaggcggcuggagcuacuacauggccacccugcagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagauacggcggcagccuggugagaugcccccugagcagaaacagcacccacgagauguacugggugagcggcgugagcggcaacaucgugagcagcgugaacaccaccagcaagaugcugcugaacagauucaccaccagacacagaaagcccaccuacgagagagacgccgaccugggcgccggcaccagaagcgugagcaccgagaccgagaagcccgacaugaccaucaucggcagaagacugcagagacugcaggaggagcacaaggagaccuggcacuacgaccacgagaaccccuacagaaccugggccuaccacggcagcuacgaggcccccagcaccggcagcgccagcagcauggugaacggcguggugaagcugcugaccaagcccugggacguggugcccauggugacccagcuggccaugaccgacaccacccccuucggccagcagagaguguucaaggagaagguggacaccagaaccccccagcccaagcccggcaccagaguggugaugaccaccaccgccaacuggcuguggacccugcugggcagaaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaaggugcuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucaccagagacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacauggacuacaugcccgugaugaagagauacagcgcccccagcgagagcgagggcgugcuguga

SEQ ID NO: 18384 - RNA, 9867 nt, Artificial Sequence
  derived and/or modified CDS sequence (opt4) from DENV-4__JX024757__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggagcgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacggcagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaaguacaugaugcuggugguggugaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugagaaucgugacccacuucgacaacacccaggugggcacccuggcccugagccugaccuucaucagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgcccugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaugaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccagaggccugaaggagagaguggagaaguggcugaaggagugcggcguggacagacugaagagaauggccaucagcggcgacgacugcguggugaagcccaucgacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccuucgagagcgagggcgugcuguga

SEQ ID NO: 18385 - RNA, 9867 nt, Artificial Sequence
  derived and/or modified CDS sequence (opt4) from DENV-4__JF741967__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcaacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucaccuucugcgccaucauccugggcggccugaccuggauggaccugcugagagugcugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagagguggaggagaccaacaugaucacccugcuggugaagcuggcccugaucaccgugagcggccuguacccccuggccauccccgugaccauggcccugugguacguguggcaggugaagacccagagaagcggcgcccugugggacgugcccagccccgccgccacccacaaggccacccugagcgagggcguguacagaaucaugcagagaggccuguucggcaagacccaggugggcgugggcauccacauggagggcguguuccacaccgugggccacgugaccagaggcagcgugaucugccacgagaccggcagacuggagcccagcuggggcgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagcccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccgugaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcaccaagaucaaguacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccgugaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccuucgagagcgagggcgugcuguga

SEQ ID NO: 18386 - RNA, 9867 nt, Artificial Sequence
  derived and/or modified CDS sequence (opt4) from DENV-4__JQ822247__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcaacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucaccuucugcgccaucauccugggcggccugaccuggauggaccugcugagagugcugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacguguggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagcccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccgugaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcaccaagaucaaguacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccgugaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccuucgagagcgagggcgugcuguga

SEQ ID NO: 18387 - RNA, 9867 nt, Artificial Sequence
  derived and/or modified CDS sequence (opt4) from DENV-4__JF262783__SS-prME
agcaccgugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugauguacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggaggugacccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacguggugggcaaggacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcaguggaacuacaaggagagaauggugaccuucaaggugccccacgccaagagacaggacgugaccgugcugggcagccaggagggcgccaugcacagcgcccugaccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggauggugagaauccugaucggccugcuggugcuguggaucggcaccaacagcagaaacaccagcauggccaugaccugcaucgccaucggcggcaucacccuguuccugggcuucaccgugcacgccgacaugggcugcgccgugagcuggagcggcaaggagcugaagugcggcagcggcaucuucgugaucgacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuuccuggagguggaggacuacggcuucggcauguucgccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacgaggugcuggagagccagaugcugauccccaaggccuacgccggccccuucagccagcacaacuacagacagggcuacgccacccagaccaucggccccuggcaccugggcaagcuggagaucgacuucggcgagugccccggcaccaccgugaccauccaggaggacugcaaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugagcgccggccagggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcgacaccaugagcggcagaaugggcggccagauccaccugaccaucauggccguguucaagaugagccccggcuacgugcugggcguguuccugagaaagcugaccagcagagagaccgcccugaucgugaucggcauggccaugaccaccgugcugagcaucccccacgaccugauggaguucaucgacggcaucagccugggccugauccugcugaagaugguggcccacuucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcagagugaucggccuguacggcaacggcaucgugaccaagagcggcgacuacgugagcgccaucacccaggccgagagaaucggcgagcccgacuacgagguggacgaggacaucuucagaaagaagagacugaccgugauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccagaagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagauccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugauggccaucgccguggccagcggccugcuguggguggccgagauccagccccaguggaucgccgccagcaucauccuggaguucuuccugauggcccugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugagcgugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggcccugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcagccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacgugaaccugggcgccggcaccagaagcgugagcaccgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacagaauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccuucgagagcgagggcgugcuguga

SEQ ID NO: 18388 - RNA, 9867 nt, Artificial Sequence
  derived and/or modified CDS sequence (opt4) from DENV-4__KU513441__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagagaguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucaucgccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaucgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugagcgugaugaagagauacagcgcccccagcgagagcgagggcgugcuguga

SEQ ID NO: 18389 - RNA, 9867 nt, Artificial Sequence
  derived and/or modified CDS sequence (opt4) from DENV-4__KC762694__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccagcagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacguguggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccgugaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaaguacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccuucgagagcgagggcgugcuguga

SEQ ID NO: 18390 - RNA, 9867 nt, Artificial Sequence
  derived and/or modified CDS sequence (opt4) from DENV-4__KC762695__SS-prME
agcaccaugacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacagcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcaacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccauccaccagguguucggcagcguguacaccaccauguucggcggcgugagcuggaugaucagaauccugaucggccugcuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuuccuggagguggaggacuacggcuucggcauguucagcaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaucgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccugguggugaccaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacgacacccaggugggcacccuggcccugagccugaccuucaucagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccguggccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaucggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccuggaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaucagcagaaccaccuggagcauccacgcccaccaccaguggaugaccaccgaggacaugcugaagguguggaacagaguguggaucgaggacaaccccaacaugaccgacaagacccccauccacagcugggaggacauccccuaccugggcaagagagaggaccuguggugcggcagccugaucggccugagcagcagagccaccugggccaagaacauccacaccgccaucagccaggugagaaaccugaucggcaaggaggaguacguggacuacaugcccgugaugaagagauacagcgcccccagcgagagcgagggcgugcuguga

SEQ ID NO: 18391 - RNA, 9867 nt, Artificial Sequence
  derived and/or modified CDS sequence (opt4) from DENV-4__KC762696__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugaucauccugaagaucgugacccacuucgacaacacccaggugggcacccuggcccugagccugaccuucaucagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacguguggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccgugaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaaguacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccccgacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccuucgagagcgagggcgugcuguga

SEQ ID NO: 18392 - RNA, 9867 nt, Artificial Sequence
  derived and/or modified CDS sequence (opt4) from DENV-4__KC762697__SS-prME
agcaccaugacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggccugcuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagugcugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucagcaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaucgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggccaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacgacacccaggugggcacccuggcccugagccugaccuucaucagaagcaccaccccccuggugauggccuggagaaccaucauggccguguucuucauggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaaggccgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggccaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaaguacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccuggaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccauccacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18393 - RNA, 9867 nt, Artificial Sequence
  derived and/or modified CDS sequence (opt4) from DENV-4__KC762698__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgugugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgccggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacguguggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaacaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccgugaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaaguacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaucgagaagcccgacaugaccaucaucggcagaagacugcagagacugagagaggagcacaaggagaccuggcacuacgaccacgagaaccccuacagaaccugggccuaccacggcagcuacgaggcccccagcaccggcagcgccagcagcauggugaacggcaucgugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacuggagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggcugcugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccuucgagagcgagggcgugcuguga

SEQ ID NO: 18394 - RNA, 9867 nt, Artificial Sequence
  derived and/or modified CDS sequence (opt4) from DENV-4__KC762699__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgagcugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacguguggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccgugaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaaguacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccuucgagagcgagggcgugcuguga

SEQ ID NO: 18395 - RNA, 9867 nt, Artificial Sequence
  derived and/or modified CDS sequence (opt4) from DENV-4__JQ915085__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaucaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggguggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcauccccagagaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggugguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccauccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccgccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccuucgagagcgagggcgugcuguga

SEQ ID NO: 18396 - RNA, 9867 nt, Artificial Sequence
  derived and/or modified CDS sequence (opt4) from DENV-4__JQ915088__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaucguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaagauccccaucgagaucagagacgugaacaaggagaagguggugggcagaaucaucagcagcacccccuucgccgagaacaccaacagcgugaucaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucagcacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaagauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucaugaccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaugagaagcaccaccccccuggugauggccuggagaaccaucauggccguguucuucgugaucacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccagacacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaccacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccauggccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcugauccacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagaauccugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcugggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacgugccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccagcaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcagccccagcgagagcgagggcgugcuguga

SEQ ID NO: 18397 - RNA, 9867 nt, Artificial Sequence
  derived and/or modified CDS sequence (opt4) from DENV-4__JQ915086__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaagauccccaucgagaucagagacgugaacaaggagaagguggugggcagaaucaucagcagcacccccuucgccgagaacaccaacagcgugaucaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagugcugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaagauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucaugaccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucgugaucacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccagacacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaccacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcugauccacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagaauccugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcugggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacgugccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccagcaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18398 - RNA, 9867 nt, Artificial Sequence
  derived and/or modified CDS sequence (opt4) from DENV-4__JQ915087__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaucguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaagauccccaucgagaucagagacgugaacaaggagaagguggugggcagaaucaucagcagcacccccuucgccgagaacaccaacagcgugaucaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaagauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucaugaccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucgugaucacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccagacacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaccacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcugauccacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagaauccugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcugggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagccugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacgugccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccagcaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18399 - RNA, 9867 nt, Artificial Sequence
  derived and/or modified CDS sequence (opt4) from DENV-4__JQ915089__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaagauccccaucgagaucagagacgugaacaaggagaagguggugggcagaaucaucagcagcacccccuucgccgagaacaccaacagcgugaucaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagugcugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaagauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucaugaccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucgugaucacccugaucccccugugcagaaccagcugccugcagaagcagagccacuggguggagaucaccgcccugauccugggcgcccaggcccugcccguguaccugaugacccugaugaagggcgccagcagcagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccagacacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagaucgacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaccacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcugauccacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagaauccugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcugggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacgugccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccagcaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18400 - RNA, 9867 nt, Artificial Sequence
  derived and/or modified CDS sequence (opt4) from DENV-4__JQ915082__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaucguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaagauccccaucgagaucagagacgugaacaaggagaagguggugggcagaaucaucagcagcacccccuucgccgagaacaccaacagcgugaucaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaagauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucaugaccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucgugaucacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccagacacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaccacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaugagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcugauccacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaucacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagaauccugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcugggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacgugccccagugggaccccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccagcaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18401 - RNA, 9867 nt, Artificial Sequence
  derived and/or modified CDS sequence (opt4) from DENV-4__JQ915081__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaucguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaagauccccaucgagaucagagacgugaacaaggagaagguggugggcagaaucaucagcagcacccccuucgccgagaacaccaacagcgugaucaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaagauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucaugaccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucgugaucacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccagacacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaccacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaugagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcugauccacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaucacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagaauccugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaucgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcugggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacgugccccagugggaccccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccagcaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18402 - RNA, 9867 nt, Artificial Sequence
  derived and/or modified CDS sequence (opt4) from DENV-4__JQ915084__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaucguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaagauccccaucgagaucagagacgugaacaaggagaagguggugggcagaaucaucagcagcacccccuucgccgagaacaccaacagcgugaucaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaagauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucaugaccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaugagaagcaccaccccccuggugauggccuggagaaccaucauggccguguucuucgugaucacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccagacacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaccacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccuggccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcugauccacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagaauccugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagaucggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacgugccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccagcaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcagccccagcgagagcgagggcgugcuguga

SEQ ID NO: 18403 - RNA, 9867 nt, Artificial Sequence
  derived and/or modified CDS sequence (opt4) from DENV-4__KM190936__SS-prME
agcaccaucacccugcugugccugauccccaccgugauggccuucagccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaugaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18404 - RNA, 9867 nt, Artificial Sequence
  derived and/or modified CDS sequence (opt4) from DENV-4__JQ915090__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaucguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcuggccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaagauccccaucgagaucagagacgugaacaaggagaagguggugggcagaaucaucagcagcacccccuucgccgagaacaccaacagcgugaucaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaagauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucaugaccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaugagaagcaccaccccccuggugauggccuggagaaccaucauggccguguucuucgugaucacccugaucccccugugcagaaccagcugccugcagaagcagagccacuggguggagaugaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaagcgacaugaucagcuacggcggcggcuggagacugggcgacaagugggacaaggaggaggacgugcaggugcuggccaucgagcccggcaagaaccccagacacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaccacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaugagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcugauccacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaucaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagaauccugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcugggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccaucgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacgugccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccagcaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcagccccagcgagagcgagggcgugcuguga

SEQ ID NO: 18405 - RNA, 9867 nt, Artificial Sequence
  derived and/or modified CDS sequence (opt4) from DENV-4__KJ160504__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucggcaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagagugggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccgccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggaucgccgagauccagccccaguggaucgccgccagcaucauccuggaguucuuccugauggugcugcugauccccgagcccgagaagcagagaaccccccaggacaaccagcugaucuacgugauccugaccgugcugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccgugcugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcuguucgugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18406 - RNA, 9867 nt, Artificial Sequence
  derived and/or modified CDS sequence (opt4) from DENV-4__GU289913__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaugaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugagcgugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18407 - RNA, 9867 nt, Artificial Sequence
  derived and/or modified CDS sequence (opt4) from DENV-4__KJ579243__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcugccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcggccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucauccugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18408 - RNA, 9867 nt, Artificial Sequence
  derived and/or modified CDS sequence (opt4) from DENV-4__KJ579246__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucauccugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccauccacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18409 - RNA, 9867 nt, Artificial Sequence
  derived and/or modified CDS sequence (opt4) from DENV-4__KJ579248__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagagugggcggccagacccaccuggccaucaucgccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaucgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugagcgugaugaagagauacagcgcccccagcgagagcgagggcgugcuguga

SEQ ID NO: 18410 - RNA, 9867 nt, Artificial Sequence
  derived and/or modified CDS sequence (opt4) from DENV-4__KJ579240__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccgugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucaucgccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaucgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugagcgugaugaagagauacagcgcccccagcgagagcgagggcgugcuguga

SEQ ID NO: 18411 - RNA, 9867 nt, Artificial Sequence
  derived and/or modified CDS sequence (opt4) from DENV-4__KJ596658__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucauccugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18412 - RNA, 9867 nt, Artificial Sequence
  derived and/or modified CDS sequence (opt4) from DENV-4__KJ596659__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucauccugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18413 - RNA, 9867 nt, Artificial Sequence
  derived and/or modified CDS sequence (opt4) from DENV-4__KJ596661__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacaucgagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccacccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggccagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18414 - RNA, 9867 nt, Artificial Sequence
  derived and/or modified CDS sequence (opt4) from DENV-4__KJ596663__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucauccugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagacccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18415 - RNA, 9867 nt, Artificial Sequence
  derived and/or modified CDS sequence (opt4) from DENV-4__KJ596664__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucaucgccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaucgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggaaccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugagcgugaugaagagauacagcgcccccagcgagagcgagggcgugcuguga

SEQ ID NO: 18416 - RNA, 9867 nt, Artificial Sequence
  derived and/or modified CDS sequence (opt4) from DENV-4__KJ596665__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcggccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucauccugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgagaacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18417 - RNA, 9867 nt, Artificial Sequence
  derived and/or modified CDS sequence (opt4) from DENV-4__KJ596668__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucauccugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagaguacggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18418 - RNA, 9867 nt, Artificial Sequence
  derived and/or modified CDS sequence (opt4) from DENV-4__KJ596670__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucgugcugggcggccugaccuggauggaccugcugagagcccugaucaugcugggcgacaccaugagcggcagaaucggcggccagacccaccuggccaucaucgccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccagaucggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaucgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugagcgugaugaagagauacagcgcccccagcgagagcgagggcgugcuguga

SEQ ID NO: 18419 - RNA, 9867 nt, Artificial Sequence
  derived and/or modified CDS sequence (opt4) from DENV-4__KJ596671__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucaucgccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaucgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugagcgugaugaagagauacagcgcccccagcgagagcgagggcgugcuguga

SEQ ID NO: 18420 - RNA, 9867 nt, Artificial Sequence
  derived and/or modified CDS sequence (opt4) from DENV-4__KJ579241__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaagaucccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucauccugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaaccaugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18421 - RNA, 9867 nt, Artificial Sequence
  derived and/or modified CDS sequence (opt4) from DENV-4__KJ596672__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucaucgccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcaucgccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaucgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugagcgugaugaagagauacagcgcccccagcgagagcgagggcgugcuguga

SEQ ID NO: 18422 - RNA, 9867 nt, Artificial Sequence
  derived and/or modified CDS sequence (opt4) from DENV-4__KJ579242__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucauccugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccugguguucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaaccaugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18423 - RNA, 9867 nt, Artificial Sequence
  derived and/or modified CDS sequence (opt4) from DENV-4__GQ398256__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagaacggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccguggccgugaccgugcacaacggcgacacccacgccgugggcaacgacaccagcagccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgagagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggauggugagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgugggccccuggcaccugggcaagcuggagaucgacuucggcgagugccccggcaccaccguggccaucagagaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuuccugagaagcaccaucccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugaagagaggcgaccugcccguguggcugagcuacaagguggccagcgccggcaucagcuacaaggacagagaguggugcuucaccggcgagagaaacaaccagauccuggaggagaacauggagguggagaucuggaccaaggagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaucggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccgccaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagauacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccgugaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcaucgugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcuggugaacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagcaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaccgagugcggcguggacagacugaagagaauggccaucagcggcgacgacugcguggugaagccccuggacgagagauucagcgccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18424 - RNA, 9867 nt, Artificial Sequence
  derived and/or modified CDS sequence (opt4) from DENV-4__KC333651__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagaacggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaucguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguuccugugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgagagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggauggugagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgugggccccuggcaccugggcaagcuggagaucgacuucggcgagugccccggcaccaccguggccaucagagaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuuccugagaagcaccaucccccuggugauggccuggagaaccaucauggccguguucuucguggugacccugaucccccugugcagaaccagcugccugcagaagcacagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugcugcuggagaaggccgccaacgugcagugggacgagauggccgacaucaccggcagcagccccaucaucgaggugaagcaggacgaggacggcagcuucagcaucagagacguggaggagaccaacaugaugacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugaagagaggcgaccugcccguguggcugagcuacaagguggccagcgccggcaucagcuacaaggacagagaguggugcuucaccggcgagagaaacaaccagauccuggaggagaacauggagguggagaucuggaccaaggagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaucggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggcccugugcgaggugcugacccuggccaccggccccgccaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagauacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccgugaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaugaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagcaggagggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaccgagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggacuacguggacuacaugcccgugaugaagagauacagcgcccccagcgagagcgagggcgugcuguga

SEQ ID NO: 18425 - RNA, 9867 nt, Artificial Sequence
  derived and/or modified CDS sequence (opt4) from DENV-4__JN559740__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacaccagagccgugggcaacgacaucagcaaccacggcgugaccgccaugaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugaagcccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaucacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgugcagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18426 - RNA, 9867 nt, Artificial Sequence
  derived and/or modified CDS sequence (opt4) from DENV-4__JN559741__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccgccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18427 - RNA, 9867 nt, Artificial Sequence
  derived and/or modified CDS sequence (opt4) from DENV-4__JQ513334__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccauggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcgagaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggagguggagcugcccgacuacggcgagcugacccuggacugcgagcccagaagcggcaucgacuucaacgagaugauccugaugaagaugaagaagaagaccuggcuggugcacaagcagugguuccuggaccugccccugcccugggccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaucccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaguggccauccugggcgagaccgccugggacuucggcagcgugggcggccuguucaccagccugggcaaggccgugcaccagguguucggcagcguguacaccaccauguucggcggcgugagcuggauggugagaauccugaucggccugcuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccuggccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18428 - RNA, 9867 nt, Artificial Sequence
  derived and/or modified CDS sequence (opt4) from DENV-4__JQ513336__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcgagaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggagguggagcugcccgacuacggcgagcugacccuggacugcgagcccagaagcggcaucgacuucaacgagaugauccugaugaagaugaagaagaagaccuggcuggugcacaagcagugguuccuggaccugccccugcccugggccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaucccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggauggugagaauccugaucggccugcuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccuggccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18429 - RNA, 9867 nt, Artificial Sequence
  derived and/or modified CDS sequence (opt4) from DENV-4__JQ513338__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggagcagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcaacacccccgccgugggcaacgacaccagcaaccacggcgugaccgcccccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacgagaaccacauguucgccggccaccugaagugcaaggugagaaugggcaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagauacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugaucgaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18430 - RNA, 9867 nt, Artificial Sequence
  derived and/or modified CDS sequence (opt4) from DENV-4__JQ513339__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggccaccuucaaggugccccacgccaagagacaggacgugacccugcugggcagccaggagggcgccaugcacagcgcccuggccggcgccaccgagguggacagcggcgacgagaaccacauguucgccggccaccugaagugcaaggugagaaugggcaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugcugagcgccaccccccuggccgagaacaccaacagcgugaccaacaucgagcuggagccccccuucggcgacagcuacaucgugaucggcgugggcaacagcgcccugacccugcacugguucaccaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugaucgaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18431 - RNA, 9867 nt, Artificial Sequence
  derived and/or modified CDS sequence (opt4) from DENV-4__JQ513343__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggagaccuucaaggugccccacgccaagagacaggacgugacccugcugggcagccaggagggcgccaugcacagcgcccuggccggcgccaccgagguggacagcggcgacgagaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugaucgaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18432 - RNA, 9867 nt, Artificial Sequence
  derived and/or modified CDS sequence (opt4) from DENV-4__KT276273__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcagacccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggagguggagcugcccgacuacggcgagcugacccuggacugcgagcccagaagcggcaucgacuucaacgagaugauccugaugaagaugaacaagaagaccuggcuggugcacaagcagugguuccuggaccugccccugcccuggaccgccggcgccgacaccagcgaggugcacuggaacaacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaaggugaucggcagagugaucagcagcaucccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugaucgacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgagaugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaucgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcauccccuacgaccugauggagcugaucgacggcaucagccugggccugauccugcugaagaucgugacccaguucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccaaggaggaguucaucagcaaggugagagccaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucgccaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugaaggagaccgccugccuggccaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacauggacuacaugcccgugaugagaagauacagcgcccccagcgagagcgagggcgugcuguga

SEQ ID NO: 18433 - RNA, 9867 nt, Artificial Sequence
  derived and/or modified CDS sequence (opt4) from DENV-4__KU523872__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggcccacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggaacggcaaggagcugaagugcggcaacggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggguggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuucaucagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccgugaucgaggugaagcaggacgaggacggcagcuucagcaucagagacguggaggagaccaacaugaucacccugcuggugaagcuggcccugaucaccgugagcggccuguacccccuggccauccccgugaccauggccaucugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggaagcugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcagcaucgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccacccugcccaccuaccugagcagcaaggccaagcuggcccuggacaacaucgugaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugguggccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaucggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggcccugugcgaggugcugacccuggccaccggccccaucaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugagagacggcagcaagaccaagcacgccgugagcagaggcagcagcaagaucagauggaucguggagagaggcaugaucaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcaagacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagauacagaaagcccaccuacgagaaggacguggaccugggcgccggcaccagaagcgugagcaccgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacguggugcccauggugacccagcuggccaugaccgacaccacccccuucggccagcagagaguguucaaggagaagguggacaccagaaccccccagcccaagcccggcaccagaaagaucaugaccaccaccgccaacuggcugugggcccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcagaugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccgagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugaagagauacagcgcccccuucgagagcgagggcgugcuguga

SEQ ID NO: 18434 - RNA, 9867 nt, Artificial Sequence
  derived and/or modified CDS sequence (opt4) from DENV-4__KP140942__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcagacccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggagguggagcugcccgacuacggcgagcugacccuggacugcgagcccagaagcggcaucgacuucaacgagaugauccugaugaagaugaacaagaagaccuggcuggugcacaagcagugguuccuggaccugccccugcccuggaccgccggcgccgacaccagcgaggugcacuggaacaacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaaggugaucggcagagugaucagcagcaucccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugaucgacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgagaugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaucgccggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccagguggccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaugggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagccugacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccaaggaggaguucaucagcaaggugagagccaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucgccaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugaaggagaccgccugccuggccaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacauggacuacaugcccgugaugagaagauacagcgcccccagcgagagcgagggcgugcuguga

SEQ ID NO: 18435 - RNA, 9867 nt, Artificial Sequence
  derived and/or modified CDS sequence (opt4) from DENV-4__KU523871__SS-prME
agcaccaugacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagaacggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaucguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgagagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggauggugagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccagaggcaagagagcccugaccccccccgugaacgaccugaaguacagcuggaagaccuggggcaaggccaagaucuucacccccgaggccagaaacagcaccuuccugaucgacggccccgacaccagcgagugccccaacgagagaagagccuggaacuucuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccagaagcuacgccggccccuucagccagcacaacuacagacagggcuacgccacccagaccgugggccccuggcaccugggcaagcuggagaucgacuucggcgagugccccggcaccaccguggccaucagagaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggccaccgccggccagggcaccagcgagaccuucagcaugggccugcugugccugacccuguucguggaggagugccugagaagaagagugaccagaaagcacaugauccuggugguggugaucaccuucugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccguguucagcaucccccacgaccugauggagcugaucgacggcaucagccugggccugauccugcugaagaucgugacccacuucgacaacacccaggugggcacccuggcccugagccugaccuuccugagaagcaccaccccccuggugauggccuggagaaccaucauggccguguucuucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaugacccugcuggugaagcuggcccugaucaccgugagcggccuguacccccuggccauccccgugaccauggcccugugguacaucuggcaggugaagacccagagaagcggcgcccugugggacgugcccagccccgccgccacccagaaggccacccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacaagaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccugcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagagagugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugaagagaggcgaccugcccguguggcugagcuacaagguggccagcgccggcaucagcuacaaggacagagaguggugcuucaccggcgagagaaacaaccagauccuggaggagaacauggagguggagaucuggaccaaggagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcaaggccaagcuggcccuggacaacaucaucaugcugcacaccaccgagaagggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaucggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggcccugugcgaggugcugacccuggccaccggccccgccaugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgccagcggcaacaucgugagcagcgugaacaccaucagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugagagaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacguggugcccauggugacccagcuggccaugaccgacaccacccccuucggccagcagagaguguucaaggagaagguggacaccagaaccccccagcccaagcccggcaccagaaugaucaugaccaccaccgccaacuggcuguggacccugcugggcaagaagaagagccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaugugguacauguggcugggcgccagauuccuggaguucgaggcccugggcuuccugaacgaggaccacugguucagcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagacccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaccgagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccguguacagcugggaggacauccccuaccugggcaagagagaggaccuguggugcggcagccugaucggccugagcagcagagccaccugggccaagaacauccacaccgccaucacccaggugagaaaccugaucggcaaggaggacuacguggacuacaugcccaucaugaagagauacagcgcccccagcgagagcgagggcgugcuguga

SEQ ID NO: 18436 - RNA, 9867 nt, Artificial Sequence
  derived and/or modified CDS sequence (opt4) from DENV-4__HQ332175__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcguggaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucgcccaggugagaaaccugaucggcaaggaggaguacguggacuacaugcccgugaugaagagauacagcgcccccagcgagagcgagggcgugcuguga

SEQ ID NO: 18437 - RNA, 9867 nt, Artificial Sequence
  derived and/or modified CDS sequence (opt4) from DENV-4__HQ332172__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccaccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccauccugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggcccugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18438 - RNA, 9867 nt, Artificial Sequence
  derived and/or modified CDS sequence (opt4) from DENV-4__HQ332176__SS-prME
agcaccaucacccugcugugccugauccccaccgugauggccuuccaccugagcaccagagacggcgagccccugaugaucguggccagacacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccagcuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18439 - RNA, 9867 nt, Artificial Sequence
  derived and/or modified CDS sequence (opt4) from DENV-4__HQ332174__SS-prME
agcaccaucacccugcugugccugauccccaccgccauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggcccugaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccaccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcgccaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcagagagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgccagcgaccugaaguacagcuggaagaccuggggcaaggccaagaucuucacccccgaggccagaaacagcaccuuccugaucgacggccccgacaccagcgagugccccaacgagagaagagccuggaacagcuucgagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagagagccagccugaucgaggugaagaccugccuguggcccaagacccacacccuguggagcaacggcgugcuggagagccagaugcugauccccaagagcuacgccggccccuucagccagcacaacuacagacagggcuacgccacccagaccaugggccccuggcaccugggcaagcuggagaucgacuucggcgagugccccggcaccaccgugaccauccaggagaacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcgccagcgagaccuucagcaugggccugcugugccugacccuguucguggaggagugccugagaagaagagugaccagaaagcacaugauccuggccguggugaucacccugugcgccaucauccugggcggccugaccuggauggaccugcugagagcccugaucaugcugggcgacaccaugagcggcagaaucggcggccagacccaccuggccaucauggccguguucaagaugagccccggcuacgugcugggcguguuccugagaaagcugaccagcagagagaccgcccugauggugaucggcauggccaugaccaccacccugagcaucccccacgaccugauggagcugaucgacggcaucagccugggccugauccugcugaagaucgugacccaguucgacaacacccaggugggcacccuggcccugagccugaccuucaucagaagcaccaugagccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccaucaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggccaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaaccgugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugagagagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18440 - RNA, 9867 nt, Artificial Sequence
  derived and/or modified CDS sequence (opt4) from DENV-4__KT026308__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacaugguggacagaggcuggggcaacggcugcggccuguucggcaagggcggcguggugaccugcgccaaguucagcugccugggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugcagcugcccgacuacggcgagcugacccuggacugcgagcccagaagcggcaucgacuucaacgagaugauccugaugaagaugaagaccaagaccuggcuggugcacaagcagugguuccuggaccugccccugcccuggaccaccggcgccgacacccuggaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcaccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggccugcuggugcuguggaucggcaccaacagcagaaacaccagcauggccaugagcugcaucgccgugggcggcaucacccuguuccugggcuucaccgugcacgccgacaugggcugcguggugagcuggagcggcaaggagcugaagugcggcagcggcaucuucgugaucgacaacgugcacaccuggaccgagcaguacaaguuccagcccgagagccccgccagacuggccagcgccauccugaacgcccacaaggagggcgugugcggcaucagaagcaccaccagacuggagaacgugauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgagaccagaaacagcaccuuccugguggacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccaucagccagcacaacuacagacagggcuacgccacccagaccgccggccccuggcaccugggcaagcuggagaucgacuucggcgagugccccggcaccaccgugaccgugcaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugagcgccggccacggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcgacaccaugagcggcagaaugggcggccagauccaccuggccaucauggccguguucaagaugagccccggcuacgugcugggcaucuuccugagaaagcugaccagcagagagaccgcccugauggugaucggcauggccaugaccaccgugcugagcaucccccacgaccugauggaguucaucgacggcaucagccugggccugauccugcugaagauggugacccacuucgacaacacccaggugggcacccuggcccuggcccugaccuucaucaagagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacaccgagggcguguuccacaccauguggcacgugaccagaggcagcgugaucugccacgagagcggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccguguucaugaccgccaccccccccggcaccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucgugaucaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagccacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaugggcaagcugagcaugggccugaucgccaucgccguggccagcggccugcuguggguggccgagauccagccccaguggaucgccgccagcaucauccuggaguucuuccugauggugcugcuggugcccgagcccgagaagcagagaaccccccaggacaaccagcugaucuacgugauccugaccauccugaccaucaucgcccugguggccgccaacgagaugggccugaucgagaagaccaagaccgacuucggcuucuaccaggugaaggccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaugggcgagacccugggcgagaaguggaagagacagcugaacagccuggacagaaaggaguucgaggaguacaagagaagcggcauccuggagguggacagaaccgaggccagaagcgcccugaaggacggcagcaagaucaaguacgccgugagcagaggcaccagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgugagcggcaacaucgugagcagcgugaacaccaccagcaagaugcugcugaacagauucaccaccagacacagaaagcccaccuacgagaaggacgccgaccugggcgccggcaccagaagcgugagcaccgagaccgagaagcccgacaugaccaucaucggcagaagacugcagagacugcaggaggagcacaaggagaccuggcacuacgaccacgagaaccccuacagaaccugggccuaccacggcagcuacgaggcccccagcaccggcagcgccagcagcauggugaacggcguggugaagcugcugaccaagcccugggacguggugcccauggugacccagcuggccaugaccgacaccacccccuucggccagcagagaguguucaaggagaagguggacaccagaaccccccagcccaagcccggcacccagguggugaugaccaccaccgccaacuggcuguggacccugcugggcagaaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagaugaccccccaccacaagauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucaccagagacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugagaagauacagcgcccacuucgagagcgagggcgugcuguga

SEQ ID NO: 18441 - RNA, 9867 nt, Artificial Sequence
  derived and/or modified CDS sequence (opt4) from DENV-4__KT026309__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucauccugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacaugguggacagaggcuggggcaacggcugcggccuguucggcaagggcggcguggugaccugcgccaaguucagcugccugggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugcagcugcccgacuacggcgagcugacccuggacugcgagcccagaagcggcaucgacuucaacgagaugauccugaugaagaugaagaccaagaccuggcuggugcacaagcagugguuccuggaccugccccugcccuggaccaccggcgccgacacccuggaggugcacuggaaccacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcaccggcgcccccugcaaggugcccaucgagaucagagacgugaacaaggagaagguggugggcagaaucaucagcagcacccccuucgccgagaacaccaacagcgugaccaacaucgagcuggagccccccuucggcgacagcuacaucgugaucggcgugggcgacagcgcccugacccugcacugguucagaaagggcagcagcaucggcaagauguucgagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggccugcuggugcuguggaucggcaccaacagcagaaacaccagcauggccaugagcugcaucgccgugggcggcaucacccuguuccugggcuucaccgugcacgccgacaugggcugcguggugagcuggagcggcaaggagcugaagugcggcagcggcaucuucgugaucgacaacgugcacaccuggaccgagcaguacaaguuccagcccgagagccccgccagacuggccagcgccauccugaacgcccacaaggagggcgugugcggcaucagaagcaccaccagacuggagaacgugauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgagaccagaaacagcaccuuccugguggacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccaucagccagcacaacuacagacagggcuacgccacccagaccgccggccccuggcaccugggcaagcuggagaucgacuucggcgagugccccggcaccaccgugaccgugcaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugaacgagaaggaggagaacauggugaagagccaggugagcgccggccacggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcgacaccaugagcggcagaaugggcggccagauccaccuggccaucauggccguguucaagaugagccccggcuacgugcugggcaucuuccugagaaagcugaccagcagagagaccgcccugauggugaucggcauggccaugaccaccgugcugagcaucccccacgaccugauggaguucaucgacggcaucagccugggccugauccugcugaagauggugacccacuucgacaacacccaggugggcacccuggcccuggcccugaccuucaucaagagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacaccgagggcguguuccacaccauguggcacgugaccagaggcagcgugaucugccacgagagcggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccguguucaugaccgccaccccccccggcaccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucgugaucaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugagaaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagccacaagguggccagcgccggcaucagcuacaaggacagagaguggugcuucaccggcgagagaaacaaccagauccuggaggagaacaucgagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaugggcaagcugagcaugggccugaucgccaucgccguggccagcggccugcuguggguggccgagauccagccccaguggaucgccgccagcaucauccuggaguucuuccugauggugcugcuggugcccgagcccgagaagcagagaaccccccaggacaaccagcugaucuacgugauccugaccauccugaccaucaucgcccugguggccgccaacgagaugggccugaucgagaagaccaagaccgacuucggcuucuaccaggugaaggccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgugggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaugggcgagacccugggcgagaaguggaagagacagcugaacagccuggacagaaaggaguucgaggaguacaagagaagcggcauccuggagguggacagaaccgaggccagaagcgcccugaaggacggcagcaagaucaaguacgccgugagcagaggcaccagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaagacacggcggcagccuggugagaugcccccugagcagaaacagcacccacgagauguacugggugagcggcgugagcggcaacaucgugagcagcgugaacaccaccagcaagaugcugcugaacagauucaccaccagacacagaaagcccaccuacgagaaggacgccgaccugggcgccggcaccagaagcgugagcaccgagaccgagaagcccgacaugaccaucaucggcagaagacugcagagacugcaggaggagcacaaggagaccuggcacuacgaccacgagaaccccuacagaaccugggccuaccacggcagcuacgaggcccccagcaccggcagcgccagcagcauggugaacggcguggugaagcugcugaccaagcccugggacguggugcccauggugacccagcuggccaugaccgacaccacccccuucggccagcagagaguguucaaggagaagguggacaccagaaccccccagcccaagcccggcacccagguggugaugaccaccaccgccaacuggcuguggacccugcugggcagaaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagaugaccccccaccacaagauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucaccagagacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaucgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgccaugagaagauacagcgcccacuucgagagcgagggcgugcuguga

SEQ ID NO: 18442 - RNA, 9867 nt, Artificial Sequence
  derived and/or modified CDS sequence (opt4) from DENV-4__KF907503__SS-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaugaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccgacaugggcugcguggugagcuggagcggcaaggagcugaagugcggcagcggcaucuucgugguggacaacgugcacaccuggaccgagcaguacaaguuccagcccgagagccccgccagacuggccagcgccauccugaacgcccacaaggacggcgugugcggcaucagaagcaccaccagacuggagaacgugauguggaagcagaucaccaacgagcugaacuacgugcugugggagggcggccacgaccugaccgugguggccggcgacgugaagggcgugcugaccaagggcaagagagcccugaccccccccgugagcgaccugaaguacagcuggaagaccuggggcaaggccaagaucuucacccccgaggccagaaacagcaccuuccugaucgacggccccgacaccagcgagugccccaacgagagaagagccuggaacagccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaagagcuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccagcaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugaccgccggccagggcaccagcgagaccuucagcaugggccugcugugccugacccuguucguggaggagugccugagaagaagagugaccagaaagcacaugauccuggugguggugaucacccugugcgccaucauccugggcggccugaccuggauggaccugcugagagcccugaucaugcugggcgacaccaugagcggcagaaucggcggccagauccaccuggccaucauggccguguucaagaugagccccggcuacgugcugggcguguuccugagaaagcugaccagcagagagaccgcccugauggugaucggcauggccaugaccaccgugcugagcaucccccacgaccugauggagcugaucgacggcaucagccugggccugauccugcugaagaucgugacccaguucgacaacacccaggugggcacccuggcccugagccugaccuucaucagaagcaccaugccccugaucauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcagaagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacguggaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccacccagaaggccgcccugagcgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaucggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccagcaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugauccugaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagacccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccagauggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcagagccuaccagcacgcccugaacgagcugcccgagagccuggagacccugaugcugguggcccugcugggcgccaugaccgccggcaucuuccuguucuucaugcagggcaagggcaucggcaagcugagcaugggccugaucaucaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaccgccagccuggugaugcugagcgugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccauccugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcaaccuggugagaugcccccugagcagaaacagcacccacgagauguacugggugagcggcgccagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggagaucgacaagaaggacggcgaccugauguacgccgacgacaccgccggcugggacaccagaaucaccgaggacgaccugcagaacgaggagcugaucaccgagcagauggccccccaccacaagauccuggccaaggccaucuucaagcugaccuaccagaacaagguggugaaggugcugagacccacccccagaggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcagaaccccaagggccugaaggagagaguggagaaguggcugaaggagugcggcguggacagacugaagagaauggccaucagcggcgacgacugcguggugaagccccuggacgagagauucggcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccagcgagagcgagggcgugcuguga

SEQ ID NO: 18443 - RNA, 9867 nt, Artificial Sequence
  derived and/or modified CDS sequence (opt4) from DENV-4__AY947539__SS-prME
agcaccaugacccugcugugccugauccccaccgccauggccuuccaccugagcaccagagacggcgagccccugaugaucguggccagacacgagagaggcagaccccugcuguucaagaccaccgagggcaucaacaagugcacccugaucgccauggaccugggcgagaugugcgaggacaccgugaccuacgagugcccccugcuggugaacaccgagcccgaggacaucgacugcuggugcaaccugaccagcgccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaucaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacauccccaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccugggccgccggcgccgacaccagcgaggugcacuggaacuacaaggagagaauggugaccuucaaggugccccacgccaagagacaggacgugaccgugcugggcagccaggagggcgccaugcacagcgcccugaccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagaaucaucagcagcacccccuucgccgaguacaccaacagcgugaccaacaucgagcuggagccccccuucggcgacagcuacaucgugaucggcgugggcgacagcgcccugacccugcacugguucagaaagggcagcagcaucggcaagaugcuggagagcaccuacagaggcgccaagagaauggccauccugggcgagaccgccugggacuucggcagcgugggcggccugcugaccagccugggcaaggccgugcaccagguguucggcagcguguacaccaccauguucggcggcgugagcuggauggugagaauccugaucggcuuccuggugcuguggaucggcaccaacagcagaaacaccagcauggccaugaccugcaucgccgugggcggcaucacccuguuccugggcuucaccgugcacgccgacaccggcugcgccgugagcuggagcggcaaggagcugaagugcggcagcggcaucuucgugaucgacaacgugcacaccuggaccgagcaguacaaguuccagcccgagagccccgccagacuggccagcgccauccugaacgcccacgaggacggcgugugcggcaucagaagcaccaccagacuggagaacaucauguggaagcagaucaccaacgagcugaacuacgugcugugggagggcggccacgaccugaccgugguggccggcgacgugaagggcgugcugagcaagggcaagagagcccuggccccccccgugaacgaccugaaguacagcuggaagaccuggggcaaggccaagaucuucacccccgaggccaagaacagcaccuuccugaucgacggccccgacaccagcgagugccccaacgagagaagagccuggaacuuccuggagguggaggacuacggcuucggcauguucaccaccaacaucuggaugaaguucagagagggcagcagcgaggugugcgaccacagacugaugagcgccgccaucaaggaccagaaggccgugcacgccgacaugggcuacuggaucgagagcagcaagaaccagaccuggcagaucgagaaggccagccugaucgaggugaagaccugccuguggcccaagacccacacccuguggagcaacggcgugcuggagagccagaugcugauccccaaggccuacgccggccccuucagccagcacaacuacagacagggcuacgccacccagaccgugggccccuggcaccugggcaagcuggagaucgacuucggcgagugccccggcaccaccgugaccauccaggaggacugcgaccacagaggccccagccugagaaccaccaccgccagcggcaagcuggugacccaguggugcugcagaagcugcaccaugcccccccugagauuccugggcgaggacggcugcugguacggcauggagaucagaccccugagcgagaaggaggagaacauggugaagagccaggugagcgccggccagggcaccagcgagaccuucagcaugggccugcugugccugacccuguucguggaggagugccugagaagaagagugaccagaaagcacaugauccuggugguggugaccacccugugcgccaucauccugggcggccugaccuggauggaccugcugagagcccugaucaugcugggcgacaccaugagcggcagaaugggcggccagauccaccuggccaucauggccguguucaagaugagccccggcuacgugcugggcaucuuccugagaaagcugaccagcagagagaccgcccugauggugaucggcauggccaugaccaccgugcugagcaucccccacgaccugauggaguucaucgacggcaucagccugggccugauccugcugaagauggugacccacuucgacaacacccaggugggcacccuggcccugagccugaccuucaucagaagcaccaugccccuggugauggccuggagaaccaucauggccgugcuguucguggugacccugaucccccugugcagaaccagcugccugcagaagcagagccacuggguggagaucaccgcccugauccugggcgcccaggcccugcccguguaccugaugacccugaugaagggcgccagcaagagaagcuggccccugaacgagggcaucauggccgugggccuggugagccugcugggcagcgcccugcugaagaacgacgugccccuggccggccccaugguggccggcggccugcugcuggccgccuacgugaugagcggcagcagcgccgaccugagccuggagaaggccgccaacgugcagugggacgagauggccgacaucaccggcagcagccccaucaucgaggugaagcaggacgaggacggcagcuucagcaucagagacaucgaggagaccaacaugaucacccugcuggugaagcuggcccugaucaccgugagcggccuguacccccuggccauccccgugaccaugacccugugguacauguggcaggugaagacccagagaagcggcgcccugugggacgugcccagccccgccgccgcccagaaggccacccugaccgagggcguguacagaaucaugcagagaggccuguucggcaagacccaggugggcgugggcauccacauggagggcguguuccacaccauguggcacgugaccagaggcagcgugaucugccacgagaccggcagacuggagcccagcugggccgacgugagaaacgacaugaucagcuacggcggcggcuggagacugggcgacaagugggacaaggaggaggacgugcaggugcuggccaucgagcccggcaagaaccccaagcacgugcagaccaagcccggccuguucaagacccugaccggcgagaucggcgccgugacccuggacuucaagcccggcaccagcggcagccccaucaucaacagaaagggcaaggugaucggccuguacggcaacggcguggugaccaagagcggcgacuacgugagcgccaucacccaggccgagagaaccggcgagcccgacuacgagguggacgaggacaucuucagaaagaagagacugaccaucauggaccugcaccccggcgccggcaagaccaagagaauccugcccagcaucgugagagaggcccugaagagaagacugagaacccugauccuggcccccaccagagugguggccgccgagauggaggaggcccugagaggccugcccaucagauaccagacccccgccgugaagagcgagcacaccggcagagagaucguggaccugaugugccacgccaccuucaccaccagacugcugagcagcaccagagugcccaacuacaaccugaucgugauggacgaggcccacuucaccgaccccagcagcguggccgccagaggcuacaucagcaccagaguggagaugggcgaggccgccgccaucuucaugaccgccaccccccccggcgccaccgaccccuucccccagagcaacagccccaucgaggacaucgagagagagauccccgagagaagcuggaacaccggcuucgacuggaucaccgacuaccagggcaagaccgugugguucgugcccagcaucaaggccggcaacgacaucgccaacugccugagaaagagcggcaagaaggugauccagcugagcagaaagaccuucgacaccgaguaccccaagaccaagcugaccgacugggacuucguggugaccaccgacaucagcgagaugggcgccaacuucagagccggcagagugaucgaccccagaagaugccugaagcccgugaucagcaccgacggccccgagagagugauccuggccggccccauccccgugacccccgccagcgccgcccagagaagaggcagaaucggcagaaaccccgcccaggaggacgaccaguacguguucagcggcgacccccugaagaacgacgaggaccacgcccacuggaccgaggccaagaugcugcuggacaacaucuacacccccgagggcaucauccccacccuguucggccccgagagagagaagaaccaggccaucgacggcgaguucagacugagaggcgagcagagaaagaccuucguggagcugaugagaagaggcgaccugcccguguggcugagcuacaagguggccagcgccggcaucagcuacaaggacagagaguggugcuucaccggcgagagaaacaaccagauccuggaggagaacauggagguggagaucuggaccagagagggcgagaagaagaagcugagacccaaguggcuggacgccagaguguacgccgaccccauggcccugaaggacuucaaggaguucgccagcggcagaaagagcaucacccuggacauccugaccgagaucgccagccugcccaccuaccugagcagcagagccaagcuggcccuggacaacaucgugaugcugcacaccaccgagagaggcggcaaggccuaccagcacgcccugaacgagcugcccgagagccuggagacccugaugcugguggcccugcugggcgccaugaccgccggcaucuuccuguucuucaugcagggcaagggcaucggcaagcugagcaugggccugaucgccaucgccguggccagcggccugcuguggguggccgagauccagccccaguggaucgccgccagcaucauccuggaguucuuccugauggugcugcugauccccgagcccgagaagcagagaaccccccaggacaaccagcugaucuacgugauccugaccauccugaccaucaucggccugaucgccgccaacgagaugggccugaucgagaagaccaagaccgacuucggcuucuaccaggugaagaccgagaccaccauccuggacguggaccugagacccgccagcgccuggacccuguacgccguggccaccaccauccugacccccaugcugagacacaccaucgagaacaccagcgccaaccugagccuggccgccaucgccaaccaggccgccgugcugaugggccugggcaagggcuggccccugcacagaauggaccugggcgugccccugcuggccaugggcugcuacagccaggugaaccccaccacccugaucgccagccuggugaugcugcuggugcacuacgccaucaucggccccggccugcaggccaaggccaccagagaggcccagaagagaaccgccgccggcaucaugaagaaccccaccguggacggcaucaccgugaucgaccuggagcccaucagcuacgaccccaaguucgagaagcagcugggccaggugaugcugcuggugcugugcgccggccagcugcugcugaugagaaccaccugggccuucugcgaggugcugacccuggccaccggccccgugcugacccugugggagggcaaccccggcagauucuggaacaccaccaucgccgugagcaccgccaacaucuucagaggcagcuaccuggccggcgccggccuggccuucagccugaucaagaacgcccagacccccagaagaggcaccggcaccaccggcgagacccugggcgagaaguggaagagacagcugaacagccuggacagaaaggaguucgaggaguacaagagaagcggcauccuggagguggacagaaccgaggccaagagcgcccugaaggacggcagcaagaucaagcacgccgugagcagaggcagcagcaagaucagauggaucguggagagaggcauggugaagcccaagggcaaggugguggaccugggcugcggcagaggcggcuggagcuacuacauggccacccugaagaacgugaccgaggugaagggcuacaccaagggcggccccggccacgaggagcccauccccauggccaccuacggcuggaaccuggugaagcugcacagcggcguggacguguucuacaagcccaccgagcagguggacacccugcugugcgacaucggcgagagcagcagcaaccccaccaucgaggagggcagaacccugagagugcugaagaugguggagcccuggcugagcagcaagcccgaguucugcaucaaggugcugaaccccuacaugcccaccgugaucgaggagcuggagaagcugcagagaaagcacggcggcagccuggugagaugcccccugagcagaaacagcacccacgagauguacugggugagcggcgugagcggcaacaucgugagcagcgugaacaccaccagcaagaugcugcugaacagauucaccaccagacacagaaagcccaccuacgagaaggacguggaccugggcgccggcaccagaagcgugagcaccgagaccgagaagcccgacaugaccaucaucggcagaagacugcagagacugcaggaggagcacaaggagaccuggcacuacgaccaggagaaccccuacagaaccugggccuaccacggcagcuacgaggcccccagcaccggcagcgccagcagcauggugaacggcguggugaagcugcugaccaagcccugggacgugauccccauggugacccagcuggccaugaccgacaccacccccuucggccagcagagaguguucaaggagaagguggacaccagaaccccccagcccaagcccggcaccagaauggugaugaccaccaccgccaacuggcugugggcccugcugggcaagaagaagaaccccagacugugcaccagagaggaguucaucagcaaggugagaagcaacgccgccaucggcgccguguuccaggaggagcagggcuggaccagcgccagcgaggccgugaacgacagcagauucugggagcugguggacaaggagagagcccugcaccaggagggcaagugcgagagcugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucggcagagagaacagcuggagcggcguggagggcgagggccugcacagacugggcuacauccuggaggacaucgacaagaaggacggcgaccugaucuacgccgacgacaccgccggcugggacaccagaaucaccgaggacgaccugcugaacgaggagcugaucaccgagcagauggccccccaccacaagauccuggccaaggccaucuucaagcugaccuaccagaacaagguggugaaggugcugagacccacccccaagggcgccgugauggacaucaucagcagaaaggaccagagaggcagcggccaggugggcaccuacggccugaacaccuucaccaacauggaggugcagcugaucagacagauggaggccgagggcgugaucacccaggacgacaugcacaaccccaagggccugaaggagagaguggagaaguggcugaaggagugcggcguggacagacugaagagaauggccaucagcggcgacgacugcguggugaagccccuggacgagagauucagcaccagccugcuguuccugaacgacaugggcaaggugagaaaggacaucccccagugggagcccagcaagggcuggaagaacuggcaggaggugcccuucugcagccaccacuuccacaagaucuucaugaaggacggcagaagccugguggugcccugcagaaaccaggacgagcugaucggcagagccagaaucagccagggcgccggcuggagccugagagagaccgccugccugggcaaggccuacgcccagauguggagccugauguacuuccacagaagagaccugagacuggccagcauggccaucugcagcgccgugcccaccgagugguuccccaccagcagaaccaccuggagcauccacgcccaccaccaguggaugaccaccgaggacaugcugaagguguggaacagaguguggaucgaggacaaccccaacaugaccgacaagacccccgugcacagcugggaggacauccccuaccugggcaagagagaggaccuguggugcggcagccugaucggccugagcagcagagccaccugggccaagaacauccacaccgccaucacccaggugagaaaccugaucggcaaggaggaguacguggacuacaugcccgugaugaagagauacagcgcccccuucgagagcgagggcgugcuguga

SEQ ID NO: 18444 - RNA, 9879 nt, Artificial Sequence
  derived and/or modified CDS sequence (opt5) from DENV-1__AB608789__SS-prME
agcgugaccaugcugcucaugcugaugcccacagcccuugcuuuccaccugacgaccagaggcggggagccucauaugaucgucacaaagcaggaacggggaaaaucccuccuguuuaagaccucugccggcguuaacaugugcacacuuauugcgauggaccugggggagcucugugaagauaccaugacauacaaaugcccgcgcaucaccgaggcugaacccgacgauauugacuguuggugcaaugccacggauaccugggugacauauggaaccuguagccaaacaggcgagcacagacgggacaagcgcuccguggcccuggcuccucaugucgggcugggacucgagaccagaacggaaacauggaugucuagcgagggcgccuggaaacagauccagcggguggaaaccugggcucugcgccaccccggcuucacaguuauugcccuuuuucuggcgcaugccaucgggaccuccaucacccagaagggaauuaucuucauucuccugaugcuugugacaccuucuauggcuaugagaugcgucggcaucgggagccgggauuuuguggagggacuguccggcgccacguggguugacgugguccucgagcacgggagcugugugaccacaauggcuaaggauaaacccacccuggacauugaacugcucaagacagaggugaccaacccugccguccugcgcaaacuuugcaucgaagcgaagauuucuaauacgacaaccgauuccagauguccgacccaaggagaggccacacugguugaagagcaggacgcuaacuucgugugccggcgcaccuuuguggauagaggcuggggcaauggguguggacucuucggcaaagggagccugaucacaugcgccaaguuuaagugcgucacgaaacuugagggaaagaucgugcaguacgaaaaccugaaauauucuguuauugugaccguccacacaggcgaccagcaucaaguggggaaugaguccaccgaacacggaacaaccgcuacgaucaccccccaggccccuacaagcgagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccccccuuuggcgagagcuauaucgugauuggggccggagaaaaagcucuuaagcucucuugguucaagagaggcagcuccaucgggaaaauguuugaggccacagcucgcggcgcccggagaauggcgauccugggagauaccgccugggacuucggcucuauugggggaguguuuacaagcguuggcaagcugguccaucagaucuucgggaccgcuuacggagugcucuuuuccggcgugagcuggacgaugaaaauugggaucggcguccugcuuaccuggcugggacucaauucucgcuccacaagccugucuaugaccuguauugccgugggccugguuacacuuuaccucggggugaugguccaggcugauuccggaugcgugaucaacuggaagggccgggaacugaaaugugggagcggaauuuucguuaccaaugaggugcacacauggaccgaacaauauaaguuucaggccgacuccccuaagagacugucugcggccaucggcaaagcuugggaggagggggucugcggcauccgcagcgccacgcggcucgaaaacauuauguggaagcagaucuccaacgagcugaaucauauucuucuggaaaacgacaugaaauucacagugguugugggagaugucgugggcauccucgcucaggggaagaaaaugauuagaccgcaacccauggaguacaaguauucuuggaaaagcuggggaaaggccaagaucaucggcgccgacgugcagaauaccaccuuuauuaucgaugggccuaacacacccgaauguccugacgaucagcgcgcuuggaauauuugggaggucgaggacuacggauucggcaucuuuaccacgaacauuuggcugaaacugcgggauuccuauacacagguuugcgaccacagacuuaugagcgcggccaucaaggauucuaaagcugugcacgccgacaugggcuacuggaucgaauccgagaagaaugaaaccuggaaacucgcccgcgcuagcuucauugaggugaagacauguaucuggcccaagucucauacccugugguccaacgggguccuggaaagcgagaugauuaucccgaaaauuuauggaggcccuaucucucaacacaauuaccggcccggguacuucacacagaccgccggaccuuggcaucucggcaagcuggagcuugauuuugaccugugcgaagggacgaccgugguuguggaugagcacugcggaaacagaggccccagccuccggacaaccacagucaccggcaaaaucauucacgaaugguguugccgcuccuguacgcugccuccccugagauucaagggggaggacggaugcugguauggcauggagauccggccggugaaagaaaaggaggaaaaucuuguuaagagcauggugucugcgggguccggagaggucgacagcuuuucccucggccugcuguguaugucuauuaugaucgaagaggugaugagaagccgcuggucccggaaaaugcucaugacagggacccuggcuguuuuccuucugcucauuaugggacagcugacauggaacgaucugaucagacuuugcauuauggugggcgccaaugccucugaccgcaugggcauggggaccaccuaccuggcucucauggccacauuuaagaugagaccuauguucgcggucggacugcucuuucggcgccugacgagcagagaggugcuucugcucaccaucggccugucccugguggcuucugucgaacuucccaacagccuggaggaacucggggauggacuggccaugggcaucaugauucucaaacugcuuacagacuuccaaucccaucagcugugggccacccuccugagccugacauuuaucaagaccacgguuucucuucacuaugcuuggaaaacaauggccauggugcuguccauugugagccucuucccccugugucucucuaccaccucccagaagacaaccuggcugccuguccuucuggggagccugggaugcaagccgcucacaauguuucugaucgcugagaauaaaauuuggggccggaagucuuggccccuuaacgaaggcaucauggccguggggaucguuuccauucugcucagcucccugcucaaaaacgaugugccucuggcgggaccccuuaucgccggcgggaugcugauugcuuguuacgucaucagcggaucuagcgccgaccugucccucgagaaggcugccgaggugucuugggaagaggaagccgagcauagcggcgcuucccacaauauucugguugaagugcaggaugacgggacgaugaaaaucaaggaugaggagcgcgacgauacccuuacaauccugcucaaagcgacccugcucgccgucucuggaguguauccucugagcauucccgcuacacuuuucgucugguacuuuuggcaaaagaagaaacagagauccggcgugcugugggacaccccuucucccccggaaguugagcgggccgugcuggaugaaggcaucuaucgcauuaugcagagagggcuccugggacggagccaggucggcguggggguuuuccaagagaacguguuccauacgauguggcacgucacccgcggagccgugcuuauguaccagggcaagagacuggagccuuccugggcuagcgugaaaaaggaccucaucucuuacgggggaggcuggcggcugcagggcuccuggaauacaggggaagagguucaggucauugccguggaacccggaaaaaacccuaagaaugugcaaaccgcgcccggcacauuuaagaccccggagggggaagucggagcuaucgcccucgacuucaaaccuggcacaagcgggucucccauugugaacagagagggaaagaucguuggccuguauggcaaugggguggucacgaccuccggaacauacgugagcgccaucgcucaggccaaagcgucccaggagggcccucuucccgaaauugaggaugaaguuuuucgcaagcggaaccugaccaucauggaccugcaccccgggucuggaaaaaccagacgcuaucucccugcuauugugcgggaggccaucaagagaaagcugcgcacacuuauucuggccccgacgcgggucguggcuagcgaaauggccgaggcucucaaaggcaugcccaucagauaccaaaccacagccguuaaguccgagcauaccgggaaagaaaucguggaucugaugugccacgcgacauucaccaugcgccugcucagcccuguccgggugcccaauuauaacaugauuaucauggacgaggcccauuuuacggauccuucuuccauugcugccagaggcuacaucagcacacgggugggaaugggcgaagcugccgccauuuucaugaccgcuacccccccugggucugucgaggcguuuccgcagagcaaugccguuauccaggacgaagagcgcgauauccccgagagauccuggaacucuggauaugaauggauuacagacuucccuggcaagaccgugugguuugugcccagcaucaaauccgggaaugauauugcuaacugucuucggaagaauggaaagcgcgucauccagcugucuagaaaaacauucgacaccgaguaccaaaagacgaaaaacaacgauugggacuacgugguuacaaccgacauuagcgaaaugggcgccaauuuucgggccgauagagugaucgacccucgccggugccugaagcccgucauucucaaagaugggccggagagagugauccuggcuggcccuaugcccguuacaguggccuccgcggcucagcgccggggaagaaucggccgcaaccacaauaaggagggggaccaguauauuuacaugggacagccccuuaacaaugaugaagaccaugcccacuggaccgaggccaagaugcugcucgauaacaucaauacgccugaaggcauuauccccgcucuguucgagccugaacgggagaaaagcgccgcgauugacggggaguauagacugcgcggagaagccagaaagaccuucgucgagcucaugcggcgcggcgaucuuccgguguggcugucuuacaaagucgcuuccgaaggguuucaauauagcgacagacgguggugcuucgauggcgagcgcaacaaucaggugcuggaagagaacauggacguugagaucuggacaaaggaaggagagagaaaaaagcuccggcccagauggcuggaugcccgcaccuacuccgacccucuugcucugcgggaauuuaaagaguucgccgcuggcagacgcucugugagcggggaccucauccuggaaauuggaaagcugccccagcaccucacacagcgggcccaaaaugcgcuugauaaccuggugaugcugcauaauuccgagcagggcgggagagccuaucggcacgcuauggaggaacucccugacaccaucgagacacugaugcuucuggcccucauugcuguccugaccggaggcguuacgcuguuuuuccucucuggccgcgggcuuggaaagacaagcaucggccugcugugugugauggccuccagcgugcuccuguggauggccucugucgaaccccauuggauugcugcguccaucauccuugaguuuuuccugauggugcuccugauuccggagccugauagacagcggaccccccaggacaaccaacuggccuacguugugaucgggcuccuuuuuaugauucugaccgucgcugccaaugaaaugggacugcucgagacaaccaaaaaggaucugggcaucgggcacguggccgucgaaaaccaccaucacgcuacaaugcuugacguggaucugcauccugccagcgcguggacgcucuacgccguugcuaccacaauuaucacccccaugaugcgccacacaauugagaacaccacggccaauaucucucugaccgcuaucgccaaccaggcggccauucugaugggacucgacaaaggcuggccuaucuccaagauggauauuggcgugccccuucuggcucuggggugcuauagccaggucaauccgcucacacugaccgccgcugugcuuaugcugguugcccauuacgcuaucauuggaccuggccuccaagccaaagcgacaagagaagcccagaagcggaccgcugccgggaucaugaagaaccccacgguggacggaaucgucgcuauugaucuggaccccgugguguaugaugccaaauucgagaagcagcugggccagaucaugcuccuuauucuguguacaucucaaauccugcucaugcgcaccacaugggcccugugcgagagcauuacccuugcgaccgggccucugacaacgcucugggaaggauccccgggcaaauuuuggaauaccacaaucgcuguuucuauggccaacaucuucagaggcagcuaccuggcuggggccggacuggccuuuucccucaugaagagccuuggcgggggacggcgcggcaccggggcucagggagagacacugggcgaaaaauggaagagacagcugaaucagcucuccaagucugaguucaacaccuauaaacggagcggcauuauggaagucgacagauccgaggccaaggagggggugaaacgcggagaaacgacaaagcacgcggugucucggggcaccgccaaacugagaugguucgucgagcgcaaucuuguuaagcccgaagggaaggugaucgaccugggauguggccgggggggauggagcuacuauugcgcuggccucaaaaaggugaccgaggucaaaggcuacacaaaggggggaccuggccacgaagagcccauuccuauggccaccuacggguggaaccuggugaaacugcauuccggaaaggauguuuuuuucacacccccugagaaaugugacacgcuccuuugcgauaucggcgaaucuagcccgaaucccaccauugaggaagggagaacacugcgcgugcugaagauggucgagccuuggcuccggggaaaccaauuuuguaucaagauucugaaucccuauaugccuuccgugguugagacccuugaacagaugcagagaaaacacggcggcaugcuggugcgcaacccccucagccggaauucuacacaugagauguacugggucuccugcgggaccggaaacaucgugagcgcugugaauaugacgucuagaaugcugcugaaccgcuucaccauggcccaccggaagccgacauaugaaagagacgucgaucucggcgcggggacccgccacguugccguggagccugaaguggcuaaccuggacaucauuggacagagaaucgagaauauuaaacaugagcacaaguccacauggcauuacgaugaagacaaccccuauaaaaccugggccuaccacggcagcuaugaggucaagcccucuggguccgcuagcuccauggugaauggaguugugaagcuucugacaaaaccuugggaugucauccccauggugacccaaauugccaugacggacacaaccccuuuuggccagcagcggguuuucaaggaaaaaguggauacccgcacaccgaaggcuaaaagaggcacggcccaaaucauggaggucaccgcgcgguggcucuggggguuucugagcagaaacaagaagccccggaucuguacacgcgaagaguucaccagaaaagugcggucuaaugccgcuauuggagccguuuuuguggacgagaaccaguggaauagcgcuaaggaagccgucgaggacgaacgcuucugggaucuugugcauagagagcgggaacugcacaaacagggcaagugcgccacaugcgucuacaacaugauggggaaacgcgagaagaagcucggagaguuuggcaaagcgccugaauccagagcuaucugguacauguggcugggggcccgguuccuggaguuugaagcccucggcuucaugaaugaggaccacugguucucucgcgagaacagccuguccggaguggaaggcgaggggcuucauaagcugggauauauucucagagauaucucuaaaauucccggcgggaauauguacgcugacgauaccgccggaugggacacacggaucaccgaagaugaccugcagaacgaggcuaagaucacggauauuauggaaccugagcacgcccuucuggcgaccagcaucuuuaaacucacauaucaaaauaagguugugcgcguccagagacccgccaaaaacggcaccgugauggacgugauuucccggcgcgaucagagagggucuggccagguuggaacauacggccugaauaccuucacgaacauggaggcucaacugauccggcagauggaaagcgaggggauuuuuuccagcucugaacucgagacaccgaaccuggccgaaagagugcuugacuggcugggaaaguauggcgucgagcgccucaagcggauggcuaucuccggggaugacugugugguuaaaccuaucgacgauagauucgccaccgcgcugacagcccuuaaugacgugggaaagguccgcaaagauauuccccagugggagccuagcaagggcuggaacgacuggcagcaagugcccuuuugcucucaucacuuccaccagcugaucaugaaagaugggcgggaaauugucgugccuuguagaaaucaggacgagcucguuggccgcgcucgggugucccagggagccggcuggagccugagagaaaccgcuugccuggggaaguccuacgcccaaauguggcagcucauguauuuucaucgccgggaucugagacuugcugccaacgcgaucuguucugccguccccguggacuggguuccgacgagccgcaccacaugguccauucacgcucaucaccaguggaugaccacagaggauaugcugagcguguggaaucgggucuggaucgaagagaacccuuggauggaggacaagacccaugugucuuccuggggagaugugcccuaccucggcaaaagagaagaccaauggugcgggagccugauuggacuuacagcccgggccaccugggcuacgaauauccagguugccaucaaccaggucagacgccugauuggcaaugagaacuaccucgacuauaugacaucuaugaagcgguucaaaaaugaaagcgaucccgagggggcgcugugguga

SEQ ID NO: 18445 - RNA, 9879 nt, Artificial Sequence
  derived and/or modified CDS sequence (opt5) from DENV-1__AB608788__SS-prME
agcgugaccaugcugcucaugcugcuucccacaguccuggccuuccaccucacgaccagaggcggggagccucauaugaucguuacaaagcaggaacggggaaaaucccugcuuuuuaagaccucugcuggcgugaacaugugcacacugauugccauggaccucggggagcugugugaagauaccaugacauacaaaugcccgcgcaucaccgaggcggaacccgacgauguggacuguuggugcaaugcuacggauaccugggucacauauggaaccuguagccaaacaggcgagcacagacgggacaagcgcuccguggcccuggccccucauguugggcucggacuggagaccagaacggaaacauggaugucuagcgagggcgcuuggaaacagauucagcggguggaaaccugggcccuucgccaccccggcuucacagucaucgcucuguuucucgcccaugcgauugggaccuccaucacccagaagggaaucauuuucauccugcuuaugcuggugacaccuucuauggccaugagaugcguuggcauugggaaccgggauuuuguggagggacucagcggcgcuacgugggucgacguggugcuggagcacggguccugugucaccacaauggccaaggauaaacccacccuggacaucgaacuccugaagacagagguuaccaauccugcugugcuucgcaaacugugcauugaagccaagaucagcaacacgacaaccgauucuagauguccgacccaaggagaggcgacacucguggaagagcaggacgccaauuucgucugccggcgcaccuuuguggauagaggcuggggcaacggguguggacuguucggcaaagggucccuuauuacaugcgcuaaguuuaagugcguuacgaaacuggagggaaagaucgugcaguacgaaaaucucaaauauagcgucaucgugaccguucacacaggcgaccagcaucaaguggggaacgagucuaccgaacacggaacaaccgccacgauuaccccccaggcuccuacauccgagauccagcugaccgacuacggcgcccugacacucgauuguagcccccggaccggccuggacuucaaugaaaugguccuucugacgaugaaggagaaaucuuggcucgugcauaagcagugguuucuggaucuuccucugcccuggacauccggggccaccacaagccaagagaccuggaaccgccaggaccuccuggucaccuucaaaacagcucacgcgaagaagcaggaagugguugugcugggaucccaagagggcgccaugcacacggcucucaccggggccacagaaauucagaccucuggaacaaccacgaucuuugccggccaucugaaaugcagacuuaagauggauaaacugacacucaaggggaugagcuaugucauguguaccggcuccuucaaacuggagaaggaaguggcugagacccagcacggaacaguucuggugcaggucaaguacgagggcaccgacgccccgugcaaaauuccuuucagcacacaagaugaaaagggggugacgcagaauggacgggugaucaccgcgaaccccaucguuacagacaaagagaagccugucaauauugaagcugagccccccuuuggcgagucuuauaucguggugggggccggagaaaaagcccuuaagcucuccugguucaagaaaggcagcaccauugggaagauguuugaggcuacagccagaggcgcucgccggauggccauccugggagauaccgcgugggacuucggcucuauugggggagucuuuacgagcgugggcaaacugguucaucagaucuucgggaccgccuacggagugcucuuuuccggcgucucuuggacaaugaagaucgggauuggcgugcugcuuaccuggcugggacucaacagcagauccacaagccugucuaugaccuguaucgcuguuggccuggugacacuuuaccucggggucauggugcaggccgauuccggauauguuauuaauuggaaaggccgcgaacugaagugcgggagcggaaucuucgugaccaacgagguccacacguggacagaacaauacaaguuucaggcugacucuccuaaacggcuguccgccgcgauuggcaaggccugggaggaggggguguguggcaucagaagcgcuacccgccucgaaaacauuauguggaaacagaucuccaaugagcugaaccauauccuucuggaaaaugacaugaaguucaccguggucguuggagaugugucuggcauucucgcccaggggaaaaagaugauccggccgcaacccauggagcacaaauauagcuggaaguccuggggaaaggcuaaaauuaucggcgccgacgugcagaacucuacauuuauuaucgaugggccuaauacccccgaaugcccugacgaucagagagccuggaacaucugggaggucgaggacuacggauucggcauuuuuacgacaaauaucuggcugaagcugcgcgauagcuauacccaggugugugaccaccggcuuauguccgcugcgauuaaagauagcaaggccguucaugcugacaugggcuacuggaucgaaucugagaaaaacgaaacauggaagcucgccagagccuccuucauugaggugaagaccugcgucuggcccaaaagccacacacuguggucuaauggggugcuggaauccgagaugaucaucccgaagauuuauggaggcccuaucagccaacauaacuaccgccccggguacuucacccagacgucuggaccuuggcaccucggcaaacuggagcuugauuuugaccugugugaagggaccacaguuguggucgaugagcacugcggaaaucggggccccagccucagaaccacaaccgugacgggcaagauuauccaugaauggugcugucgguccugcacacugccuccccugcgcuucaaaggggaggacggauguugguauggcauggagauuagaccgguuaaggaaaaggaggaaaaccuugugaaaagcauggucucugcuggguccggagagguggacagcuuuucccucggccugcugugcaucucuaucaugauugaagaggugaugcggagcagauggucccgcaagaugcucaugaccgggacacuggccgucuuccuucugcucaucaugggacagcugaccuggaaugaucugauucggcuuuguaucaugguuggcgcgaacgcuucugacagaaugggcauggggaccacauaccuggcccucauggccacguuuaaaaugcgcccuauguucgcugugggacugcucuuuagacggcugaccagccgcgaggugcuucugcucacaauuggccugucccuggucgccucuguggaacuucccaauagccuggaggaacucggggauggacuggcgaugggcaucaugauucucaagcugcuuaccgacuuccaaucccaccagcugugggcugcccuccugagccugacauuuaucaaaaccacguucucucuucauuaugccuggaagacaauggcuaugguucuguccaucgugagccucuuuccccugugccucucuaccaccucccagaagacaaccuggcugccuguccuucuggggagccugggauguaaaccgcucacaauguuccugauugccgagaacaagaucuggggcagaaaaucuuggccccuuaacgaaggcauuauggcuguggggaucguuuccauucugcucagcucccugcucaagaaugaugugccucuggccggaccccuuaucgcgggcgggaugcugaucgccugcuacgucauuagcggaucuagcgcugaccugucccucgagaaagccgcugaggugucuugggaagaggaagccgagcacagcggcgccucccauaacauccuggucgaagugcaggaugacgggacgaugaagauuaaagaugaggagcgggacgauacccuuacaauccugcucaaggcuacccugcucgcgguuucuggaguguauccucugagcauucccgccacacuuuuugucugguacuucuggcaaaagaaaaagcagcgcuccggcgugcugugggacaccccuucucccccggaaguugagagagcugugcuggaugacggcaucuaucggaucaugcagcgcgggcuccugggaagaagccaggucggcguggggguguuccaagaaaauguuuuucacacgauguggcacgucacccggggagccgugcuuauguaccagggcaaacgccuggagccuuccugggccagcgugaagaaagaccucauuucuuacgggggaggcuggagacugcagggcuccuggaacacaggggaggaaguccaggugaucgcuguugagcccggaaagaauccuaagaacgugcaaaccgcccccggcacauucaaaaccccggaaggggaggucggagcgauugcucucgauuuuaagccuggcacaagcgggucucccaucgugaaucgggaaggaaaaauuguuggccuguauggcaacgggguggucacgaccuccggaacauacgugagcgccaucgcccaggcuaaggccucccaggagggcccucuucccgagauugaagacgagguuuucagaaaacgcaaucugaccaucauggaucugcaucccgggucuggaaagacccggagauaucucccugcgaucgugcgcgaagcuauuaagcggaaacugagaacacuuauccuggccccgacgcgcgucguggccagcgagauggcugaagcccucaagggcaugcccauucgguaccaaaccacagcugugaaauccgagcacaccgggaaggagaucgucgaccugaugugucaugccacauuuaccaugagacugcucagcccuguucgcgugcccaacuauaauaugauuaucauggaugaagcgcacuucacggacccuucuuccaucgccgcucggggcuacauuagcacaagagugggaaugggcgaggccgcugccaucuuuaugaccgccacccccccugggucugucgaagcuuucccgcagagcaacgcggugauucaggaugaggaacgggacauccccgagcgcuccuggaauucuggauaugauuggauuacagacuuuccuggcaaaaccguuugguucgugcccagcaucaaguccgggaacgauaucgccaauugccuuagaaagaacggaaaacgggucauucagcugucucgcaagacauuugacaccgaguaccaaaaaacgaagaacaaugacugggauuacgugguuacaaccgacaucagcgaaaugggcgcuaacuucagagccgaucgggugauugacccuagacgcugucugaaacccgucauccucaaggaugggccggagcgggugauucuggccggcccuaugcccgucacaguggcuuccgccgcgcagagacgcggacggaucggcagaaaucagaacaaggaaggggaccaguauauuuacaugggacaaccccuuaauaacgaugaggaccaugcucacuggaccgaggccaaaaugcugcucgauaauaucaacacgccugaaggcaucauucccgcccuguucgagccugaacgcgagaagagcgcugccaucgacggggaauaucggcugagaggagaggcgcgcaaaaccuuuguugagcucaugagacggggcgaucuuccgguguggcugucuuacaagguggccuccgaaggguuccaguauagcgaccgcagauggugcuuugauggcgagcggaauaaccagguccuggaagagaauauggacguugaaauuuggacaaaagagggagagcgcaagaaacucagaccccgguggcuggacgcuagaaccuacuccgauccucuugcccugcgcgaauucaaggaguuugcugccggccggagaucugugagcggggaccucauccuggaaauuggaaagcugccccagcaccucacacaacgcgcucagaacgcccuugauaaucuggugaugcugcauaacuccgagcagggcgggcgggcguauagacacgccauggaagagcucccugacaccaucgagacacugaugcuucuggcucucaucgccguccugaccggaggcgugacgcuguucuuucucucuggccgggggcuuggaaaaacaagcauuggccugcugugcguuauggcuuccagcgugcuccuguggauggccucugucgaaccccauuggaucgccgcuuccauuauccuugaguucuuucugauggugcuccugauuccggaaccugaucgccagagaaccccccaagacaaucagcuggcguacgucgugaucgggcuccuuuucaugauccugaccguugccgcuaacgagaugggacugcucgagacaaccaagaaagaucugggcauugggcacguggccgucgaaaaccaccaucacgccacaaugcuugacguggaucugcauccugcuagcgccuggacgcucuacgcgguugccaccacaaucauuacccccaugaugcggcacacaaucgagaauaccacggcuaacauuucucugaccgccaucgcuaaucaggccgcgauucugaugggacucgacaagggcuggccuaucuccaaaauggauaucggcgugccccuucuggcccugggguguuauagccaagucaacccgcucacacugaccgcugccgugcuuaugcugguggcucauuacgccauuaucggaccuggccuccaggcuaaggccacacgcgaagcgcagaagagaaccgccgcugggauuaugaaaaaucccacgguugacggaaucgucgccauugaucuggaccccgugguguaugacgcuaaguuugagaaacagcugggccaaaucaugcuccuuauccugugcacaucucagauucugcucaugcggaccacaugggcccugugugaaagcaucacccuugccaccgggccucugacaacgcucugggagggauccccgggcaaguucuggaacaccacaauugcggucucuauggcuaauaucuuucgcggcagcuaccuggccggggcuggacuggccuucucccucaugaaaagccuuggcgggggaagacggggcaccggggcccagggagagacacugggcgaaaaguggaagcgccagcugaaccaacucuccaaaucugaguucaauaccuauaagagaagcggcauuaucgaaguugaucgguccgaggcuaaagaagggcugaagagaggagagacgacaaaacacgccgugucucgcggcaccgcgaagcuucggugguuuguggagagaaaccuggucaagcccgaagggaaagugaucgaccucggaugcggccgcgggggauggagcuacuauugugccggccugaagaaaguuaccgaggugaagggcuacacaaaagggggagcuggccacgaagagccuauucccauggccaccuacggguggaaucuggucaagcucuauuccggaaaagauguguucuuuacaccucccgaaaagugcgacacgcuucugugugauaucggcgagucuagcccuaacccgaccauugaggaagggcggacacugagaguucucaagaugguggagcccuggcugcgcggaaaucaguucugcaucaaaauucuuaacccuuacaugcccuccgucguggaaacccuggagcagaugcagcggaagcauggcggcaugcucgugagaaauccucugagccgcaacucuacacacgagauguauugggucuccugugggaccggaaauaucguuagcgcugugaacaugacgucucggaugcugcucaacagauuuaccauggcccaucgcaaacccacauacgaacgggacguggaucugggcgcggggaccagacacgucgccguggagccggaaguugcuaaucuugacauuaucggacaacgcaucgagaacauuaagcacgaacauaaauccacauggcacuaugaugaggacaauccuuacaagaccugggccuaucauggcagcuacgaggugaagcccucuggguccgcuagcuccauggucaacggagugguuagacugcucacaaaacccugggaugugaucccuauggucacccagauugccaugacggacacaacccccuucggccagcaacggguguuuaaggaaaaaguugacacccgcacaccuaaggcuaaacagggcacggcccaggugauggaggucaccgcgagauggcuguggggguuccuuagccggaauaagaagccgagaaucugcacacgggaagaguuuacccgcaaagugagaucuaacgccgcuauuggagccgucuucguggaugaaaaucaguggaacagcgcuaaggaggccguugaggacgaacgguuuugggaucuggugcaccgcgagagagaacuccauaaacaaggcaagugugccacaugcgucuacaauaugauggggaaacgggagaagaagcugggagaauucggcaaagcgaaggggucccgcgcuaucugguauauguggcugggcgccagauuucucgaguucgaggcccugggauucaugaacgaagaccacugguuuucucgggagaauagccuuuccggcguggaaggggagggacugcaccgccucggcuacauccugagagauauuucuaaaauccccgggggaaacauguaugcugacgauaccgccggcugggacacacggauuaccgaggaugaccuucagaaugaagcuaagaucacggauauuauggagccugaacaugcccugcucgcgaccagcaucuucaaacugacauaccagaacaaggugguucgcgugcagagacccgccaaaaaugggaccgucauggacgugaucucccggcgcgaucaaagaggcucuggacagguuggcacauaugggcugaacaccuuuacgaacauggaggcucagcucauucggcagauggaaagcgagggaaucuucuccccuagcgagcuggaaacacccaaucuugccgagagagugcuggacuggcucgaaaaguacggcgucgagcgccugaagcggauggcuauuucuggggacgauugcguggucaaaccgaucgacgauagauuugccaccgcgcuuacagcccugaacgacaugggaaaggugcgcaaagauauuccucaaugggaacccuccaagggcuggaaugacuggcagcagguuccuuucuguagccaccauuuucaccagcucaucaugaaagaugggcgggagaucgugguccccugcagaaaccaagacgagcuggugggccgcgcucggguuucucagggagccggcuggucccugagagaaaccgcuugucucgggaagagcuaugcccagauguggcaacugauguacuuccaccgccgggaucuuagacuggcugccaaugcgauuugcuccgccgugccugucgacugggugcccacgucucgcaccacauggagcauccaugcucaccaucaguggaugaccacagagaacaugcucuccguguggaaucggguuuggauugaagagaacccguggauggaagauaagacccacgucagcucuugggaggacgugccuuaccugggaaaaagagaggaccagugguguggcucccuuaucgggcugacagcccgggccaccugggcuacgaauauucagguggccaucaaccaagucagacgccucauuggaaaugaaaacuaucuggauuacaugacaagcaugaagcgguuuaaaaaugacucugaucccgagggcgcgcugugguga

SEQ ID NO: 18446 - RNA, 9879 nt, Artificial Sequence
  derived and/or modified CDS sequence (opt5) from DENV-1__AB608786__SS-prME
agcgugaccaugcugcucaugcugaugcccacagcccuugcuuuccaccugacgaccagaggaggggaaccucauaugaucgucuccaagcaggaacggggaaaaucucuccuguuuaagacaagcgccggcguuaacaugugcacccuuauugccauggaccugggggaacucugugaagauacaaugaccuacaaaugccccagaaucacagaaaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugucauugggaccucuaucacccagaagggaaucauuuucauccuccugaugcuugugacaccuagccuggcgaugagaugcguuggcauugggucccgggauuuuguggagggacucagcggcgccacgugggucgacguggugcuggagcacgggucuugugucaccacaauggcuaaggauaaacccacccuggacaucgaacuccugaagacagagguuaccaacccugccgugcuucgcaaacugugcauugaagcuaagaucuccaauacgacaaccgauagcagauguccgacccaaggagaggccacacucguggaagaacaggacgcgaacuucgucugccggcgcaccuuuguggauagaggcuggggcaauggguguggacuguucggcaaagggucucuuauuacaugcgccaaguuuaagugcguuacgaaacuggagggaaagaucgugcaguacgaaaaccucaaauauuccgucaucgugaccguucacacaggcgaccagcaucaaguggggaaugagagcaccgaacacggaacaaccgcuacgauuacaccccaggccccuacaaccgagauccagcugacagacuacggcgcucugacccucgauuguucuccccggacgggccuggacuucaacgaaaugguccuucugacaaugaaggagaaauccuggcucgugcauaagcagugguuucuggaucuuccucugcccuggaccagcggggccuccacaucucaagagaccuggaaucgccaggaccuccuggucaccuucaaaacagcccacgcuaagaagcaggaagugguugugcugggaagccaagagggcgcgaugcacacggcccucaccggggcuacagaaauucagaccuccggaacaaccacgaucuuugccggccaucugaaaugcagacuuaagauggauaaacugacacucaaggggaugagcuaugucauguguaccggcucuuucaaacuggagaaggaaguggccgagacccagcacggaacaguucuggugcagauuaaguacgagggcaccgacgcuccgugcaaaaucccuuucuccacacaagaugaaaagggggucacgcagaacggacggcuuaucaccgccaaucccauugugacagacaaagagaagccugugaacaucgaagcggagccgcccuuuggcgagagcuauauuaucauuggggcuggagaaaaagcccucaagcugucuugguucaagaaaggcagcuccaucgggaagauguuugaggccaccgcuagaggcgcccgccggauggcuauccugggagauacagccugggacuucggcucuauugggggaguuuuuaccagcgucggcaaacucgugcaucagaucuucgggacggcguacggagugcuguuuuccggcgucagcuggaccaugaagauugggaucggcgugcuucugacauggcucggacucaauucuagauccaccagccugucuaugacauguauugccguuggccuugugacccucuaccugggggucauggugcaggcugauuccggaugcguuaucaacuggaaaggccgcgaacugaagugugggagcggaauuuucgugacaaaugagguccacaccuggacggaacaauauaaguuucaggccgacuccccuaaacggcucucugcugccaucggcaaggcgugggaggagggggugugcggcaucagaagcgccacacgccuggaaaacauuauguggaaacagaucuccaacgagcuuaaucauauucugcucgaaaacgacaugaaguucaccguuguggucggagauguggcuggcauccuggcccaggggaaaaagaugauucggccgcaacccauggaguacaaauauucuuggaaaagcuggggaaaggcuaagaucaucggcgccgacgugcagaauaccacauuuauuaucgaugggccuaacacccccgaauguccugacgaucagagagccuggaauauuugggaggucgaggacuacggauucggcaucuuuacgacaaacauuuggcugaaacuucgcgauuccuauacccagguuugcgaccaccggcucaugagcgcugcgaucaaagauucuaaggccgugcacgcugacaugggcuacuggaucgaauccgagaaaaaugaaacauggaagcuggccagagccagcuucauugaggugaagaccuguaucuggcccaaaucucauacacugugguccaacgggguccucgaaagcgagaugauuaucccgaagauuuauggaggcccuaucucucaacacaauuaccgccccggguacuucacccagacggcuggaccuuggcaucugggcaaacuugagcuggauuuugaccucugcgaagggaccacagugguuguggaugagcacugcggaaaccggggccccagccugagaaccacaaccgucacgggcaagaucauucacgaaugguguugccgguccuguacacugccuccccuucgcuucagaggggaggacggaugcugguauggcauggagauccggccggugaaagaaaaggaggaaaaucucguuaagagcauggugucugccggguccggagaggucgacagcuuuucccugggccugcucuguauuucuaucaugauugaagaggugaugagaagccgcuggucccggaaaaugcugaugaccgggacacuugcgguuuucuuucugcucaucaugggacagcugaccuggaacgaucugauuagacuuugcaucauggugggcgcuaaugccucugaccgcaugggcauggggaccacauaccuggcccucauggcuacguucaagaugagaccuauguuugccgucggacugcuguuccggcgccugaccagcagagaggugcuucugcucacaaucggccugucccugguggcgucugucgaacuucccaacagccuggaggaacucggggauggacuggcuaugggcauuaugauccucaaacugcuuaccgacuuucaaucccaucagcugugggccacacuccugagccugaccuucauuaagacgacauuuucucuucacuaugccuggaaaaccauggcuaugguucuguccaucgugagccucuucccccugugucucucuaccacaucccagaagaccacauggcugccugugcuucuggggagccugggaugcaagccgcucacgauguuucugauugccgagaauaaaaucuggggccggaagucuuggccccuuaacgaaggcaucauggcugucgggauuguguccauccugcucagcucccugcucaaaaacgauguuccucuggccggaccccuuauugcgggcgggaugcugaucgccuguuacgugauuagcggaucuagcgcugaccugucccucgagaaggccgcugaggucucuugggaagaggaagccgagcauagcggcgccucccacaauauccugguggaaguucaggaugacgggaccaugaaaaucaaggaugaggagcgcgacgauacacuuaccauucugcucaaagcuacacugcucgcggugucuggagucuauccucugagcauccccgccacccuuuucgugugguacuucuggcaaaagaagaaacagagauccggcguccugugggacacgccuucucccccggaaguggagcgggcuguucuggaugacggcauuuaucgcaucaugcagagagggcuccugggacggagccaggugggcgucgggguguuucaagaaaacguuuuccauaccauguggcacgugacacgcggagccguccuuauguaccagggcaagagacuggagccuuccugggccagcgugaaaaaggaccucauuucuuacgggggaggcuggcggcugcagggcuccuggaauaccggggaggaagugcagguuaucgcugucgagcccggcaagaacccuaagaaugugcaaacagcccccggcaccuuuaagacaccggaaggggaggugggagcgauugcucucgauuucaaaccuggcacgagcgggucucccaucgucaacagagaaggaaagaucgugggccuguauggcaaugggguugugaccacauccggaaccuacgucagcgccauugcccaggcuaaagccucccaggagggcccucuucccgagaucgaagacgagguguuucgcaagcggaaccugaccauuauggaucugcaccccgggucuggaaaaacaagacgcuaucucccugcgaucguucgggaagcuauuaagagaaagcugcgcacgcuuauccuggccccgacccggguggucgccagcgagauggcugaagcccucaaaggcaugcccaucagauaccaaacaaccgcugugaaguccgagcauacagggaaagagauuguugaccugaugugccacgccaccuucacgaugcgccugcucagcccugugcggguccccaauuauaacaugaucauuauggaugaagcgcauuuuacagacccuucuuccaucgccgcuagaggcuacauuagcacccgggugggaaugggcgaggccgcugccaucuucaugaccgccacacccccugggucuguggaggcuuuuccgcagagcaaugcggucauccaggaugaggaacgcgacauucccgagagauccuggaacucuggauaugaguggaucaccgauuucccuggcaagacaguuugguuugugcccagcauuaaauccgggaaugacaucgccaacugucuucggaagaauggaaagcgcgugauucagcugucuagaaaaaccuucgauacggaauaccaaaagaccaagaacaacgacugggacuacgucgugaccacagauaucagcgagaugggcgcuaauuuccgggccgacagaguuauugauccucgccggugccugaagcccgugauccucaaagacgggccggaaagagucauccuggccggcccuaugcccgugaccguugcuuccgccgcgcagcgccggggaagaauuggccgcaaccacaauaaggagggggaucaguauaucuacaugggacagccccuuaacaaugacgaggaucaugcucacuggacggaagccaagaugcugcucgacaacauuaauaccccugagggcaucauucccgcccuguuugaaccugagcgggagaaaagcgcugccaucgauggggaguauagacugcgcggagaggcgagaaagacauucguggaacucaugcggcgcggcgaccuuccggucuggcugucuuacaaaguggccuccgagggguuucaauauagcgauagacgguggugcuucgacggcgaacgcaacaaucagguccuggaggaaaacauggauguggagaucuggaccaaggagggagaacgcaaaaagcuccggcccagauggcuggacgcucgcacauacuccgacccucuugcccugcgggaguuuaaagaguucgcugccggcagacgcucuguuagcggggaucucauucuggagaucggaaagcugccccagcaccucacccagcgggcucaaaaugcccuugacaaccuggugaugcugcauaauuccgaacagggcgggagagcguaucggcacgccauggaggagcucccugauacaauugaaacccugaugcuucuggcucucaucgccgugcugacgggaggcgucacacuguuuuuccucucuggccgcgggcuuggaaagaccagcauuggccugcuguguguuauggcuuccagcgugcuccuguggauggccucuguggagccccauuggaucgccgcuuccaucauucuugaauuuuuccugaugguccuccugaucccggagccugacagacagcggacaccccaggauaaccaacuggcguacgugguuauugggcuccuuuuuaugauccugacaguggccgcuaaugagaugggacugcucgaaaccaccaaaaaggaccugggcauugggcacgucgccguggagaaccaccaucacgccgcuaugcuugaugucgaccugcauccugccagcgcguggacgcucuacgccguggcuaccacaaucauuacccccaugaugcgccacacaaucgaaaacaccacggccaauaucucucugaccgcuauugccaaccaggcggccauccugaugggacucgauaaaggcuggccuauuuccaagauggacaucggcguuccccuucuggcucuggggugcuauagccaggugaauccgcucacacugaccgccgcuguccuuaugcugguggcccauuacgcuauuaucggaccuggccuccaagccaaagcgacaagagaggcccagaagcggaccgcugccgggaucaugaagaaccccacgguugauggaauuguggcuaucgaccuggaucccgucguguaugacgccaaauucgaaaagcagcugggccagauuaugcuccuuauccuguguacaucucaaauucugcucaugcgcaccacaugggcccugugcgagagcaucacccuugcgaccgggccucugacaacgcucugggagggauccccgggcaaauuuuggaauaccacaaucgcugugucuauggccaacauuuucagaggcagcuaccuggcuggggccggacuggccuucucccucaugaaaagccuuggcgggggacggcgcggcaccggggcucagggagaaacacugggcgagaaauggaagagacagcugaaucagcucuccaagucugaauuuaacaccuauaaaggcagcgggaucauggagguugaccgguccgaagccaaggagggacugaaaagaggcgagacgacaaagcacgcggucucucgcgggaccgccaaacuucggugguucguggaaagaaaucuggugaagcccgagggaaaggucauugaucucggcugugggcgcggaggcuggagcuacuauugcgcuggccugaaaaagguuaccgaagugaaaggguacacaaagggaggcccugggcacgaggaacccaucccuauggccaccuacggauggaaccuggugaaacuccauuccggcaaggacgucuuuuucauucccccugagaaaugugauacacuucugugcgacaucggggagucuagcccgaaucccacgauugaagagggacggacccugagagugcucaagaugguugaaccuuggcugcgcggcaaccaauuuuguaucaagauccuuaaucccuauaugccuuccguggucgagacacuggagcagaugcagcggaaacacggcgggaugcucgugagaaacccccugagccgcaauucuacccaugaaauguacuggguuuccugcggaacaggcaacauugugagcgcugucaauaugaccucucggaugcugcucaacagauucacgauggcccaccgcaagccgaccuaugagcgggauguggaccugggggcgggaacaagacacguggccgucgaaccugagguugcuaaccuugauaucauuggccagcgcaucgaaaauauuaaacaugagcacaaguccaccuggcauuacgacgaggauaaccccuauaaaacaugggccuaccacgggagcuaugaagugaagcccucuggauccgcuagcuccauggugaauggcgucgugaagcugcucaccaaaccuugggacguuauccccauggugacacaaaucgccaugaccgauacgacaccuuuuggccagcagagagucuucaaggagaaaguggacacccggaccccgaaggcuaaacgcgggacagcccaaauuauggaaguuacggcgaaguggcuguggggauuucuuagcagaaacaagaaaccccggaucuguaccagagaggaguucacacggaaggugcgcucuaaugccgcuauuggcgccgucuuuguggacgagaaccaguggaauagcgcuaaagaggccguugaagaugagagauucugggaccuggugcaucgggaacgcgagcuccacaagcaggggaaaugcgcgaccugcgucuacaacaugaugggaaagagagaaaagaaacugggcgaguuugggaaggcgaaaggcucccgggcuaucugguacauguggcugggagcccgcuuccucgaguucgaagcccugggcuuuaugaaugaggaucacugguucucuagagaaaacagccuuuccgggguggagggagagggccugcauaagcucggguauauucugcgggacaucucuaaaaucccuggaggcaauauguacgcugaugacacagccgggugggauacccgcauuacagaagacgaucuucagaacgaggcuaagaucaccgacauuauggaacccgagcacgcccugcucgcgaaaagcaucuuuaagcugacguaucaaaauaaggucgugagaguucagcggccugccaaaaacggcaccgugauggaugucauuucccgcagagaccagcggggaucuggccagguggggacauacggacugaauaccuucacaaacauggaagcucaacucauccgccagauggagagcgagggcaucuuuucccccagcgaacuggagaccccgaaccuugccgaaagagugcuggauuggcucgagaaguaugggguugaacggcugaaaagaauggcuauuucuggagacgacuguguggucaagccuaucgaugaccgcuucgccacggcgcuuacagcccugaaugauaugggcaaagugcggaaggacauuccccagugggagccuuccaagggguggaacgauuggcagcaaguucccuuuugcagccaucacuuccaccagcucaucaugaaagacggcagagagauuguggucccuugucgcaaucaggaugaacuggugggacgggcuagagucucucagggcgccggguggucccugcgcgagaccgcuugccucggaaagagcuacgcccaaauguggcagcugauguauuuucaucggagagaccuucgccuggcugccaacgcgaucuguuccgccgugcccguugauugggugccgacaucucggaccacguggagcauucacgcucaucaccaguggaugaccacagaagacaugcucuccgucuggaauagaguguggaucgaggaaaacccuuggauggaggauaaaacccauaucagcucuuggggcgacguucccuaccuggggaagcgcgaggaccaauggugcggaucccuuauuggccugacagcccgggccaccugggcuacaaauauccagguggccauuaaccaggucagacggcucaucgggaaugaaaacuaccuggauuauaugaccagcaugaaaagauucaagaaugagucugaccccgaaggcgcgcugugguga

SEQ ID NO: 18447 - RNA, 9879 nt, Artificial Sequence
  derived and/or modified CDS sequence (opt5) from DENV-1__AB608787__SS-prME
agcgugaccaugcugcucaugcugaugcccacagcccuugcuuuccaccugacgaccagaggaggggaaccucauaugaucgucuccaagcaggaacggggaaaaucucuccuguuuaagaccagcgccggcguuaacaugugcacccuuauugcgauggaccugggggagcucugugaagauacaaugaccuacaaaugccccagaaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccagggagaggccacccugguggaagaacaggacgcuaacuucgugugccggcgcacauuugucgauagaggcuggggcaauggguguggacucuucggcaaagggucucugcuuaccugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaagucgccgagacccagcacggaaccgugcugguucagaucaaguacgagggcacagacgcgccgugcaaaauuccuuucuccacccaagaugaaaagggggugacacagaacggacggcuuaucacggcuaaucccaucgucaccgacaaagagaagccugugaacauugaagccgagccgcccuuuggcgagagcuauaucgugauuggggccggagaaaaagcucucaagcugucuugguucaagaaaggcagcuccaucgggaagauguuugaggccacagcuagaggcgcccgccggauggcgauucugggagauaccgccugggacuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacucaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacaucauguggaaacagaucuccaacgagcuuaaucauauucugcucgaaaacgacaugaaguucacaguuguggucggagauguggcuggcauccuggcccaggggaaaaagaugauucggccgcaacccauggagcacaaauacucuuggaaaagcuggggaaaggccaagaucauuggcgcugacgugcaaaauuccaccuuuaucaucgaugggccuaacacccccgaauguccugacgaucagagagcguggaauauuugggaggucgaggacuauggauucggcaucuuuacaaccaacauuuggcugaaacuucgcgauagcuacacgcagguuugcgaccaccggcucaugucugccgcuaucaaagauuccaaggccgugcaugccgacaugggcuauuggauugaaagcgagaaaaaugaaacauggaagcuggcuagagccucuuucaucgaggugaagaccuguaucuggcccaaaucccacacacuguggagcaacgggguccucgaaucugagaugauuaucccgaagauuuacggaggcccuaucagccaacauaauuaucgccccggguacuucacccagacagcgggaccuuggcaccugggcaaacuugagcuggauuuugaccucugcgaagggaccacggugguuguggaugagcacugcggaaaccggggccccucccugagaaccacaaccgucacaggcaagauugugcaugaaugguguugccggagcuguacccugccuccccuucgcuucagaggggaggacggaugcugguacggcauggagauccggccgguuaaagaaaaggaggaaaaucucgugaagucuauggucuccgcugggagcggagagguggacuccuuuucucugggccugcucuguaucagcauuaucauugaagagguuaugagaucccgcuggauccggaaaaugcugaugacggggacacuuggaguguucuuucugcucauuaugggccagcugaccuggaacgaucugaucagacuuugcauuauggucggcgccaaugccucugaccgcauggggaugggaacaaccuaucuggcucucauggccaccuucaagaugagaccuauguuugcggugggccugcuguuccggcgccugacaagcagagaggugcuucugcucacgaucgggcugucccuggucgcuucuguugaacuucccaacagccuggaggaacucggagauggccuggccauggggaucaugauucucaaacugcuuaccgacuuucaaucccaccagcugugggccacacuccugagccugaccuucaucaagacaaccuuuucucuucauuacgcuuggaaaacgauggccauggugcuguccauugugagccucuucccccugugucucucuacaaccucccagaagaccacauggcugccuguccuucugggaagccugggcugcaagccgcucaccauguuucugaucgcugagaauaaaauuuggggccggaagucuuggccccuuaacgaagggaucauggccgugggaaucguuuccauucugcucagcucccugcucaaaaacgaugugccucuggcgggcccccuuaucgccgggggaaugcugauugcuuguuaugucaucagcggcucuagcgccgaccugucccucgagaaggcugccgaggugucuugggaagaggaagccgagcacagcggggcuucccauaauauucugguugaagugcaggaugacggaacaaugaaaaucaaggaugaggagcgcgacgauacgcuuaccauccugcucaaagcgacacugcucgccgucucuggcguguacccucugagcauucccgcuacccuuuucgucugguauuucuggcaaaagaagaaacagagauccggcgugcugugggacacaccuucucccccggaaguugagcgggccgugcuggaugacgggaucuaccgcauuaugcagagaggacuccugggccggagccaggucggggugggaguuuuucaagaaaacguguuccacaccauguggcacgucacgcgcggcgccgugcuuauguaucaggggaagagacuggagccuuccugggcuagcgugaaaaaggaccucaucucuuacggaggcggcuggcggcugcagggguccuggaauaccggagaggaaguucaggucauugccguggagcccggcaaaaacccuaagaaugugcaaacagcgcccgggaccuuuaagacaccggaaggagaggucggcgcuaucgcccucgauuucaaaccugggaccagcggaucucccauugugaacagagaaggcaagaucguuggccuguacgggaauggaguggucacaacguccggcaccuaugugagcgccaucgcucaggccaaagcgucccaggaggggccucuucccgagauugaagacgagguuuuucgcaagcggaaccugacaaucauggaucugcaucccggaucuggcaaaaccagacgcuaccucccugcuauugugcgggaagccaucaagagaaagcugcgcacccuuauucuggccccgacacgggucguggcuagcgagauggccgaagcucucaaagggaugcccaucagauaucaaacgaccgccguuaaguccgagcacacaggcaaagagaucguggaccugaugugccaugcgaccuucacaaugcgccugcucagcccuguccgggugcccaauuacaacaugauuaucauggaugaagcccacuuuaccgacccuucuuccauugcugccagaggauauaucagcacgcgggugggcaugggggaggcugccgccauuuucaugacagcuacacccccuggaucugucgaagcguuuccgcagagcaaugccguuauccaggaugaggaacgcgacauccccgagagauccuggaacucuggcuacgaguggauuaccgauuucccugggaagacagugugguuugugcccagcaucaaagcuggaaaugacauugccaacugucuucggaagaauggcaagcgcgucauccagcuguccagaaaaaccuucgauacagaauaucaaaagaccaaaaacaacgacugggacuacgugguuacgacagauauuucugagaugggggccaauuuccgggcugacagagugaucgauccucgccggugccugaagcccgucauucucaaagacggcccggaaagagugauccuggccggaccuaugcccguuaccguggcgagcgcugcccagcgccggggcagaaucgggcgcaaccauaauaaggagggagaucaguacauuuauaugggccagccccuuaacaaugacgaggaucacgcccacuggacagaagcuaagaugcugcucgacaacaucaauaccccugaggggauuauccccgcccuguuugaaccugagcgggaaaaauccgcggccauugauggagaguacagacugcgcggcgaggcuagaaagacguucgucgaacucaugcggcgcggggaccuuccgguguggcugagcuauaaagucgccucugagggcuuucaauacuccgauagacgguggugcuucgacggagaacgcaacaaucaggugcuggaggaaaacauggauguugagaucuggaccaaggagggcgaacgcaagaagcuccggcccagauggcuggacgcucgcacauauagcgacccucuugcccugcgggaguuuaaagaguucgcugccgggagacgcuccgugucuggagaucucauccuggagauuggcaagcugccccagcaucucacccagcgggcgcaaaaugcccuugacaaccuggugaugcugcacaauagcgaacaagggggcagagcuuaccggcaugccauggaggagcucccugauacaaucgaaacccugaugcuucuggcucucauugccguccugacaggcggcguuacccuguuuuuccucuccgggaagggacuuggcaaaacgucuaucgggcugcugugugugauggccagcuccgugcuccuguggauggcuagcgucgagccccacuggauugcggccucuaucauccuugaauuuuuccugauggugcuccugauuccggagccugaccgccagagaacaccccaggauaaccaacuggcuuauguugugaucggacuccuuuuuaugauucugaccgucgccgccaaugagaugggccugcucgaaaccacaaagaaagaccuggggaucggacacguggcugucgagaaccaucaccaugccgcgaugcuugauguggaccugcacccugccuccgcuuggacccucuacgccguugcuacaacgauuaucacccccaugaugcggcauacaauugaaaacaccacagccaauaucagccugaccgcgaucgccaaccaggcugccauucugaugggccucgauaagggcuggccuaucucuaaaauggacauuggggugccccuucuggcucugggaugcuacucccaggucaauccgcucacgcugaccgccgcugugcuuaugcugguugcccacuaugcgaucauuggcccugggcuccaagccaaggcuacacgcgaggcccagaagagaaccgcugccggaaucaugaaaaaccccacaguggauggcaucgucgccauugaccuggaucccgugguguacgacgcgaaguucgaaaaacagcuggggcagaucaugcuccuuauucuguguaccagccaaauccugcucaugcggacgacaugggcucugugcgagucuauuacccuugccacaggaccucugaccacccucugggagggcagcccgggcaaguuuuggaauacaacgaucgcuguuuccauggccaacaucuuccgcgggucuuaucuggccggagcuggccuggccuucagccucaugaaaucccuugggggaggcagacgggggaccggagcgcagggcgaaacacugggcgagaaguggaagcgccagcugaaucagcucagcaaauccgaauuuaacaccuacaaggggucuggaauuauggaggucgacagaagcgaagccaaagagggccugaagagaggggaaacaaccaaacacgcugugucccggggaacggccaaacuucgcugguucguggaacggaaucuggucaagcccgagggcaaaguuaucgaucucggguguggaagaggcggcuggucuuauuacugcgcugggcugaagaaagugacagaagugaagggauauaccaaaggcgggccuggacaugaggaacccauuccuauggccaccuacggcuggaaccuggucaagcuccacagcgggaaagacguguuuuucauucccccugagaagugugauacacuucugugcgacaucggagaguccucuccgaaucccaccaucgaagagggccgcacacugcggguucucaagaugguggaaccuuggcugaaaggcaaccaauuuuguauuaagauccuuaaucccuacaugccuagcgucguggagacgcuggagcagaugcagagaaaacaugggggaaugcucguucgcaacccccugucccggaauagcacccacgaaauguauugggugucuugcggcacagggaacaucgucuccgcggugaauaugaccagcagaaugcugcucaaccgcuucacaauggcccaccggaagccgaccuacgagagagauguggaccugggagcuggcacgcgccaugucgccguugaaccugagguggcuaaccuugauauuaucgggcagcggauugaaaauaucaaacacgagcauaagucuaccuggcacuaugacgaggauaaccccuacaagacaugggccuaucauggauccuacgaagugaaacccagcggcucugcuuccagcauggucaauggcgugguuaagcugcucaccaaaccuugggacgugauucccauggucacacaaaucgccaugaccgauacaaccccuuuugggcagcagagaguguucaaggagaaaguugacacgcgcacaccgaaggcgaagagaggaaccgcccaaaucauggaagugaccgcucgguggcugugguccuuucuuagccgcaacaaaaagcccagaauuuguacacgggaggaguucacgagaaaaguccggucuaaugccgcuaucggcgccguguuuguugacgagaaccaguggaauagcgccaaggaggcgguggaagaugagcgcuucugggaccugguccacagagaacgggagcuccacaaacaggggaagugcgcuaccugcguguauaacaugaugggaaagcgcgagaagaagcugggcgaguuugggaaagccaagggcuccagagccauuugguacauguggcugggagcucgguuccucgaguucgaagcccugggcuuuaugaaugaggaucauugguucucucgcgaaaacagccuuuccggggucgagggagagggccugcacaaacucggguacauccugagagacauuucuaagaucccuggaggcaauauguaugcugaugacacagccgggugggauacccggaucacagaagacgaucuucagaacgaggcgaaaauuaccgacaucauggaacccgagcaugcccugcucgcuaagagcauuuuuaagcugacauaccaaaauaaagugguucgcgugcagagaccugccaagaacggcaccgucauggaugugaucucccggcgcgaccagagaggaucuggccagguggggacguauggacugaauaccuucacaaacauggaagcucaacucauucggcagauggagagcgagggcaucuuuucccccagcgaacuggagaccccgaaccuugccgaacgcguucuggauuggcucgagaaauacgggguggaaagacugaagcggauggcgaucucuggagacgacugugucgugaaaccuauugaugacagauucgccacagcucuuaccgcccugaaugauaugggcaagguucgcaaggacaucccccagugggagccuuccaaaggguggaacgauuggcagcaagugcccuuuugcagccaccacuuccaucagcucauuaugaaggacggccgggagaucgucgugccuuguagaaaucaggaugaacuggucggacgcgcucgggugucucagggcgccggguggucccugagagagacggcuugccucggaaaaagcuaugcccaaauguggcagcugauguacuuucaccgccgggaccuuagacuggcggccaacgcuauuuguuccgccguucccguggauugggucccgacaucucgcaccacauggagcauccaugcccaccaucaguggaugaccacggaagacaugcucuccguguggaaucggguuuggauugaggaaaacccuuggauggaggauaagacccacaucagcucuugggaggacgugcccuaucugggcaaaagagaagaccaauggugcgggucccuuaucggacugacagcucgccccaccugggccacaaauauucaggucgcgaucaaccaggugcggagacucauuggcaaugagaacuaccuggauuacaugaccagcaugaagcgguucaagaaugaaucugagccugagggggcucugugguga

SEQ ID NO: 18448 - RNA, 9879 nt, Artificial Sequence
  derived and/or modified CDS sequence (opt5) from DENV-1__HE795086__SS-prME
agcgugacaaugcugcugaugcugaugcccacggcccuugcuuuccaccugacgaccagaggcggggagccucauaugaucgucuccaagcaggaacggggaaaaucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcguuagauccgccacccgccuggaaaacaucauguggaagcagaucucuaacgagcucaaucauauucugcuugaaaacgacaugaaauuuacgguggucgugggagauguggcuggcauccuggcccaggggaagaaaaugauucggccgcagcccauggaguacaaguauagcuggaaguccuggggaaaagccaagaucauuggcgcugacguccaaaauacaaccuucaucaucgaugggccuaacacccccgaauguccugacgaucagagagcguggaauauuugggagguugaggacuacggauuuggcaucuucacaaccaacauuuggcucaaacugcgcgauagcuauacacaggugugcgaccaccggcugaugucugccgcuaucaaggauuccaaagccgugcacgccgacaugggcuacuggauugaaagcgagaagaaugaaacauggaaacuugcuagagccucuuucaucgaggucaaaaccuguaucuggcccaagucccauacacucuggagcaacggggugcuggaaucugagaugauuaucccgaaaauuuauggaggcccuaucagccagcacaauuaccgccccggguacuuuacccaaacagcgggaccuuggcaucugggcaagcucgagcuggauuucgaccuuugcgaagggaccacgguuguggucgaugagcacugcggaaaccggggccccucccugagaaccacaaccgugacaggcaaaauuauccacgaaugguguugccggagcuguacccucccuccccugcgcuuuaagggggaggacggaugcugguauggcauggagaucagaccgguuaaggaaaaagaggaaaaucuggugaagucuauggucuccgcugggagcggagagguggacuccuucucucuuggccuccuguguauuagcaucaugauugaagagguuaugcgguccagauggucucgcaaaaugcugaugacggggacacucgccguguuuuuccugcuuaucaugggacagcugaccuggaacgaucucauucggcugugcaucauggucggcgccaaugcuagcgacagaaugggcauggggacaaccuaccuggcccuuauggcgaccuuuaagaugcgcccuauguucgcugugggacugcucuuuagacggcugacaucccgcgaggugcuccugcuuacgauuggccugucucucgucgccagcguugaacugcccaacucccuggaggaacuuggggauggacuggccaugggcaucaugauccucaaacugcucaccgacuuccagagccaucaacugugggcuacacuucugucucucaccuuuauuaagacaaccuucucccugcacuaugccuggaagacgauggcuauggugcugagcaucgugucucuuuuuccccugugucucuccacaaccagccagaaaaccacauggcugccuguccuccuggggucucuuggaugcaagccgcugaccauguuccugauugccgagaauaaaaucuggggcagaaaguccuggccccucaacgaaggcauuauggcgguggggaucguuagcauccugcuuuccagccugcucaaaaacgaugugccucuggccggaccccucauugcuggcgggaugcugaucgccuguuacgucauuucuggaagcuccgcugaccuuucucuggagaaggccgccgaggugagcugggaagaggaagcugagcauuccggcgcgucucacaauauccugguugaagugcaggaugacgggacaaugaaaauuaaggaugaggagcgggacgauacgcucaccauccugcuuaaggccacacugcucgcugucagcggaguguauccucuguccauccccgccacccucuucgucugguacuuuuggcagaaaaagaaacaacgcucuggcgugcugugggacacaccuuccccucccgaaguugagagagccgugcuugaugacggcauuuaucggaucaugcagcgcgggcugcugggaagaucccaggucggcguggggguuuuccaggaaaacguguuucauaccauguggcacgucacgcggggagcugugcucauguaccaaggcaagcgccuggagcccagcugggccucugugaaaaaggaccuuauuuccuacgggggaggcuggagacugcagggcagcuggaauaccggggaggaaguucaggucaucgcgguggagcccggaaagaacccuaaaaaugugcagacagcucccggcaccuucaagacaucugaaggggaggucggagccauugcccucgauuuuaaaccgggcaccuccgggagcccuaucgugaaccgggaaggaaagauuguuggccuguauggcaaugggguggucacaacguccggaaccuacgugucugcuaucgcccaagcgaaagcuagccaggacggcccccucccugagaucgaggaugaaguuuucagaaagcgcaaccugacaauuauggaccuucaccccggguccggaaagacccggagauaucugcccgccaucgugcgcgaggccauuaaacggaagcugagaacccucauccuggcuccuacacgcgucguggccagcgaaauggcugaggcccuuaaaggcaugccgauucgguaccagacgaccgcgguuaagucugaacauacagggaaagagaucguggaucugaugugccacgccaccuuuacaaugagacuccugucccccguccgcgugccuaauuauaacaugaucauuauggacgaggcucauuucaccgaucccagcucuaucgccgcucggggcuacauuagcacgagagugggaaugggcgaagccgccgcuaucuuuaugacagcgaccccucccggguccgucgaggccuucccucaaucuaaugcuguuauucaggacgaagaacgggauaucccggaacgcagcuggaacuccggauaugaguggaucaccgacuuucccggcaagacagugugguucgugccuucuauuaagagcgggaaugauaucgccaacugucugcgcaagaauggaaagcgggucauucagcucucccgcaaaaccuucgacacagaguaccagaagaccaaaaacaacgacugggauuacgugguuacgacagacaucagcgaaaugggcgccaauuuuagagcugaucgggugauugaccccagacgcugccuuaagccugucauccugaaggaugggcccgagcgggugauucuggccggcccgaugccuguuaccguggcgucugcugcccaaagacgcggacggaucggcagaaaccacaauaaagaaggggaccaguauaucuacaugggacagccccucaacaaugaugaggaccaugcccacuggacagaggcuaagaugcugcuugauaacauuaauacccccgaaggcaucauuccugcccuguucgagcccgaacgcgagaaauccgcggccaucgacggggaauaucggcucagaggagaggcucgcaagacguuugucgagcugaugagacggggcgaucugccuguguggcucagcuacaaagucgccuccgaaggguuccaguauucugaccgcagauggugcuuugauggcgagcggaacaaucaagugcuugaagagaacauggacguugaaauuuggaccaaggagggagagcgcaaaaagcugagaccgcgguggcuggacgcuagaacauacagcgauccccucgcccugcgcgaguucaaggaguuugcugccggccggagauccgugucuggggaccuuauccuggaaaucggaaaacucccucagcaccugacccagcgcgcgcagaaugcccuggauaaccucgugaugcuucauaauagcgagcaaggcgggcgggcuuauagacacgccauggaggaacugcccgacacaauugagacccugaugcuccuggcucuuaucgccguccugacaggaggcguuacccucuucuuucuguccggccgggggcugggaaagacgagcauuggccuccuuugugugauggccucuuccgugcugcuguggauggcuagcgucgaaccucauuggaucgcggccucuauuauccucgaguucuuucugauggugcuucugauccccgaaccggaucgccagagaacaccucaggacaaccagcucgcuuacguugugauugggcugcuguucaugauccucaccgucgccgccaaugagaugggacuucuggagaccaccaagaaggaucugggcauugggcacguggcugucgaaaaccaccaucacgccgcgaugcucgacguggaucugcaucccgccuccgcuuggacccuuuacgccguugcuacaacgaucauuaccccuaugaugcggcacacaaucgagaacaccacagccaauauuagccugaccgcgaucgccaaccaagcugccauccucaugggacuggacaaaggcuggcccauuucuaagauggauaucggcgugccucugcucgcucuugggugcuauagccaggucaauccccugacgcugaccgccgcugugcucaugcugguugcccauuacgcgauuaucggaccgggccuucaggccaaggcuacacgcgaagcccagaagagaaccgcugccgggauuaugaagaacccuacaguggacggaaucgucgccaucgaucuggaccccgugguguaugacgcgaaauuugagaagcagcucggccagauuaugcugcugauccucuguaccucccagauucuucugaugcggacgacaugggcucugugcgaaucuaucacccucgccacagggccccugaccacccuuugggagggaagcccuggcaaauucuggaauacaacgauugcuguuuccauggccaacaucuuccgcggcagcuaccuggccggggcuggacucgccuuuucccugaugaagucucugggcgggggaagacggggcaccggggcgcaaggagagacacucggcgaaaaguggaaacgccagcuuaaucagcugagcaaguccgaguucaacaccuauaaaagaucuggcaucauggaagucgaucggagcgaggccaaggaagggcugaaaagaggagagacaaccaagcacgcugugucccgcggcacggccaagcuccggugguuuguggagagaaaucuggucaaaccggaagggaagguuauugaccuuggauguggccgcgggggauggucuuacuauugcgcuggccugaaaaaggugacagaggugaaaggcuacaccaaagggggacccggccacgaggaaccuauccccauggccaccuacggguggaaccucgucaaacugcauagcggaaaggauguguucuuuauuccucccgaaaagugugacacacugcucugcgauaucggcgaguccagcccuaauccgaccauugaggaagggcggacacuuagaguucugaaaaugguggagcccuggcugcgcggaaaccaguucuguaucaagauucucaauccuuauaugcccucugucguggaaacgcuggagcaaaugcagcggaaacacggcggcaugcuuguuagaaacccucugucccgcaauagcacccaugagauguacugggugucuugcgggacaggaaacaucgucuccgcggugaauaugaccagccggaugcuccugaacagauuuacaauggcccaccgcaagcccaccuaugaacgggacguggaucugggcgcugggacgagacacgucgccguugagccggaaguggcuaaccucgacaucauuggacagcgcaucgagaauauuaaauacgaacauaagucuaccuggcacuaugaugaggacaacccuuacaagacaugggccuaucauggcuccuacgaggugaaacccagcggguccgcuagcucuauggucaauggagugguuaagcugcuuaccaaacccugggaugugaucccuauggucacacagauugccaugaccgacacaacccccuucggccaacagagaguguuuaaggaaaaaguugacacgcggacaccuaaggcgaagcgcggcaccgcccagaucauggaggugaccgcuaaauggcuguggggguuccucagcagaaacaagaaaccgcggaucuguacaagagaagaguuuacgcggaagguccgcuccaaugccgcuauuggagccguguucguugaugaaaaccaauggaacucugccaaagaggcgguggaggacgaaagauuuugggaucugguccaccgggagcgcgaacuucauaagcagggcaagugcgcuaccugcguguacaacaugauggggaaaagagagaagaaacugggagaguucggcaaggccaaagggagccgggccaucugguauauguggcucggcgcucgcuuccuggaguuugaggcccugggauucaugaaugaagaccacugguuuuccagagagaacucucucagcggcgucgaaggggagggacugcacaaacuuggcuacauucugcgggauaucuccaaaauucccgggggaaauauguaugcugacgauacagccggcugggacacccgcaucacagaggaugaccuccagaacgaagcgaagaucaccgauauuauggagccugaacaugcccugcuugcuaagucuaucuucaaacugacauaccagaauaaggugguuagagugcaacggcccgccaaaaacgggaccgucauggacgugauuagccgcagagaucagcggggcuccggacaggugggcacguaugggcucaauaccuuuacaaacauggaggcucagcugauccgccaaauggaaagcgagggaauuuucucuccuuccgagcuggaaacccccaaccucgccggcagaguucuggacuggcuugagaagcacgggguggaacggcugaaaagaauggcgaucagcggagacgauugugucgugaagccgaucgacgaucgcuuugccacagcucucaccgcccugaaugacaugggcaagguucggaaagauauuccucagugggagcccucuaagggguggaacgacuggcaacaggugccuuucugcucccaucacuuucaccaacuuaucaugaaagauggcagagaaauugucgugcccugucgcaaucaggacgagcuggucggacgggcuagagugagccagggcgccggguggucccuccgcgagacggcuugccugggaaagucuuacgcccagauguggcaacugauguauuuccaucggagagaucuccgccuggcggccaacgcuaucuguagcgccguuccuguggacuggguccccacaucccggaccacauggagcauucacgcccaucaccaguggaugaccacggaagauaugcuuucuguguggaauagaguuuggaucgaggaaaacccguggauggaggacaaaacccauauuuccagcugggaagacgugccuuaccugggcaagcgcgaggaucaguggugcgggucucucaucggacugacagcucgggccaccugggcgacaaauauccaagucgcuauuaaccaggugagacggcuuaucggcaaugagaacuaccuggacuauaugaccagcaugaagagauuuaaaaaugaauccgaucccgagggggcccucugguga

SEQ ID NO: 18449 - RNA, 9879 nt, Artificial Sequence
  derived and/or modified CDS sequence (opt5) from DENV-1__AB189120__SS-prME
agcgugaccaugcugcucaugcugcuucccacagugcugacguuccaccucaccacaagaggcggggaaccucauaugaucguuuccaagcaggaacggggaaaaucucugcuuuuuaagaccagcgccggcgugaauaugugcacacugauugcuauggaccucggggaacugugugaugacaccaugacauacaaaugcccgagaaucaccgaaacggagcccgaugacguggauuguuggugcaaugccaccgaaacaugggucaccuauggaacauguucccagaccggcgagcacagacgggacaagcgcucuguggcccuggcuccucauguugggcucggacuggagacgagaacagaaaccuggaugagcuccgagggcgccuggcggcagauucagaaaguggaaacaugggcccuucgccaccccggcuucaccgucaucgcucuguuucucgcccaugcuauugggaccucuaucacacagaagggaaucauuuucauccugcuuaugcuggugacgccuagcauggccaugagaugcguuggcauugggaaccgggauuuuguggagggacucuccggcgcgaccugggucgacguggugcuggagcacgggagcugugucacaaccauggccaaggauaaacccacacuggacaucgaacuccugaagaccgagguuacgaauccugcugugcuucgcaaacugugcauugaagccaagaucucuaacacaaccaccgauuccagauguccgacacaaggagaggcuacccucguggaagaacaagacgccaauuucgucugccggcgcacauuuguggauagaggcuggggcaacggguguggacuguucggcaaagggagccuuauuacgugcgcgaaguuuaagugcguuaccaaacuggagggaaagaucgugcaguacgaaaaucucaaauauucugucaucgugacaguucacaccggcgaccagcaucaaguggggaacgagacaaccgaacacggaacgauugccaccaucacaccccaggcuccuaccuccgagauucagcugacagacuacggcgcccugacccucgauuguagcccccggacgggccuggacuucaaugaaaugguccuucugacaaugaaggagaaaucuuggcucgugcauaagcagugguuucuggaucuuccucugcccuggaccuccggggcuagcacaucccaagagaccuggaaccgccaggaccuccuggucaccuucaaaacagcccacgccaagaagcaggaagcugugguucugggaucucaagagggcgcgaugcacacggcccucaccggggcuacagaaauccagaccagcggaacaaccacgauuuuugccggccaucugaaaugcagacuuaagauggauaaacugacacucaaggggaucuccuaugugauguguaccggcagcuucaaacuggagaaggaagucgccgagacccagcacggaacagugcugguucaggugaaguacgagggcaccgacgcuccgugcaaaaucccuuucucuucccaagaugaaaagggggucacacagaauggacggcuugugacggccaaccccauugugaccgacaaagagaagccuguuaauaucgaagcggagccgcccuuuggcgagagcuauauugucgugggggcuggagaaaaagcccucaagcugucuugguucaagaaaggcagcuccaucgggaagauguuugaggccacagcuagaggcgcccgccggauggcuauucugggagauaccgccugggacuucggcucuaucgggggaguguuuacaagcgucggcaaacucgugcaucagaucuucgggaccgcguacggaguucuguuuuccggcgugagcuggacgaugaagauugggaucggcauucuucugaccuggcucggacugaacucuagauccacaagccugucuaugaccuguaucgccgucggcauggugacacuuuaccucgggguuauggugcaggcugauuccggaugcgucauuaauuggaaaggccgcgaacugaagugugggagcggaaucuucgugaccaacgagguucacacauggaccgaacaauauaaguuucaggccgacuccccuaaacggcugucugcugccauuggcaaggcgugggaggagggggugugcggcaucagaagcgccacgcgccucgaaaacaucauguggaaacagauuuccaaugagcugaaccauauccuucuggaaaaugacaugaaguucacagucguggugggagaugucucuggcauucucgcucaggggaaaaagaccauccggccgcaacccauggagcacaaauacagcuggaaguccuggggaaaggccaaaauuaucggcgcugacguucagaacaccacauuuaucauugaugggccuaauacccccgaauguccugacgaucagagagccuggaacaucugggagguggaggacuauggauucggcauuuuuacgacaaauaucuggcugaagcugcgcgauagcuacacccaggugugcgaccaccggcuuaugucugccgcuauuaaagauuccaaggcgguccaugccgacaugggcuauuggaucgaaagcgagaaaaacgaaacauggaagcucgcuagagccucuuucaucgaggugaagaccuguguuuggcccaaaucccacacacuguggagcaauggggugcuggaaucugagaugauuaucccgaagauuuacggaggcccuaucagccaacauaacuaucgccccggguacuucacccagacggccggaccuuggcaccucggcaaacuggagcuugauuuugaccugugcgaagggaccacagucgugguugaugagcacugcggaaaucggggccccucccucagaaccacaaccgugacgggcaagauuauccaugaaugguguugccggagcuguacacugccuccccugcgcuucaaaggggaggacggaugcugguacggcauggagaucagaccggucaaggaaaaggaggaaaaccuugugaaaucuaugguuuccgcugggagcggagagguggacuccuuuucucucggccugcuguguauuagcaucaugauugaagaggucaugcgguccagauggucucgcaagaugcucaugaccgggacacuggugguguuccuucugcucacccugggacagcugaccuggaaugaucuuauccggcugugcauuauggucggcgccaacgcgagcgacaauaugggcauggggacaacguaucucgcucugauggccaccuuuagaaugcgcccuauguucgccguuggacuccuguuuagacggcuuacaucccgcgaggugcugcuccugaccgugggccugucucuugucgcuagcguggaacugcccaacucccucgaggaacugggggauggacucgccaugggcaucaugauucugaaacuucugacagacuuccaaagccaccagcucugggcgacccugcugucucuuacguuuguuaagacaacccugucccuccauuacgcuuggaaaaccauggccaugauccugagcaucgugucucuccugccccuuugucuguccacaaccagccagaagacaacguggcugccuguccuccuggggucucuuggaugcaagccgcugaccauguuccucauuacagagaacaaaaucuggggcagaaaguccuggccccugaaugaaggcauuauggccguggggaucguuagcauucuccuguccagccuucugaaaaacgaugugccucuggcuggaccccucaucgccggcgggaugcugaucgcuuguuaugucauuucuggaagcuccgccgaccuuucucuggagaaggcggccaaagugagcugggaggaagaggcugaacacuccggcgccucucauaauauccucgucgagauucaggaugacgggaccaugaagaucaaagaugaagaacgggacgauacaauuaccauccugcucaaggcuacgcugcuugccaucagcggaguguacccuauguccauucccgccacccuguuuguuugguauuucuggcaaaagaaaaagcagcgcucuggcgugcugugggacacaccuagcccucccgaggucgaaaaagcugugcucgaugacggcaucuaccgcauucugcagcgggggcuucugggacgcucccagguuggcgugggggucuuucaagagggaguguuccacaccauguggcacgugacaagaggcgcgguucucauguaucaggggaagcggcuggaacccagcugggccucugucaaaaaggaccucaucuccuacggaggcggcuggcgcuuccaggggagcuggaacaccggagaggagguccaggugauugcugucgaacccggcaagaauccuaaaaacgugcaaacagcccccgggacguuuaagaccucugagggagaaguuggcgccaucgcucuggauuucaaaccggggacauccggaagcccuauugugaauagagagggcaagaucgucggccuuuacgggaacggagugguuaccaccuccggcacauaugugucugccaucgcgcaggcuaaagccagccaggaagggccccugccugagauugaggacgaagucuuucggaagagaaaucugacgaucauggaucuccaucccggauccggcaagacccgccgguaccugcccgccauugugagagaggcuaucaaacgcaaacuucggacacugguucucgccccuaccagaguggucgcgagcgaaauggcugaggcccugaaagggaugccgauucgcuaucaaacaaccgccgugaagucugaacacacgggcaaagagaucguggaccugaugugccaugcuacauucaccaugcggcuccuuucccccgucagaguuccuaacuacaauaugaucauuauggaugaggcccacuuuaccgaccccgcuagcaucgccgcgcgcggauauauuucuacacgggugggcaugggggaagccgcugccaucuucaugaccgcuacaccucccggaagcguggaggccuuuccucaguccaacgccgucauucaggaugaagagaaggacaucccggaaagaucuuggaauagcggcuacgauuggaucaccgacuuccccgggaagacggugugguuuguuccuuccauuaaaucuggaaacgauaucgcuaauugucugcggaagaacggcaaacgcgugauucagcugagcagaaagacauucgacaccgaguaucagaagacaaagaacaaugacugggauuacgucgugaccacggacaucuccgagaugggggcgaacuuucgggccgaucgcguuauugaccccagacggugccucaagccugugauccugaaagauggccccgaaagagucauucuugcuggaccgaugccugugaccgucgccagcgccgcucagcgccggggcagaaucgggcgcaaucagaacaaggagggagaccaguacaucuauaugggccaaccccugaauaacgaugaagaccaugcccacuggacagaggcgaaaaugcuccuggauaauauuaacacccccgaggggaucauuccugcucuguucgaacccgagcgggaaaagucugccgccaucgacggagaguacagacuccgcggcgaagcucggaaaacauucguggagcuuaugagacgcggggaucugccuguuuggcuguccuauaagguggccagcgagggcuuucaguacuccgacagacgguggugcuucgauggagaacgcaauaaccaggugcucgaggaaaauauggacgucgagauuuggaccaaagaaggcgagagaaagaagcugcggccgcgcuggcuugacgcgagaacauauucugauccccuggcccuccgggaguuuaaagaguucgcugccgggagacgcagcguuuccggagaccugauccuggagaucggcaagcucccucagcaccuuacccaacgggcucagaacgcccuggauaaucuggugaugcuccauaacucugaacaagggggaaaggcuuacagacacgccauggaggaacugcccgacacgauugagacaaucaugcuucuggcgcucauugccgugcugaccggcggcgucacccuguuuuuccucagcgggcgcggacuuggcaagacauccaucgggcugcugugugugauguccucuagcgcucuccuguggauggccagcguugagccucauuggauugcugccucuaucauccuugaauuuuuccugauggugcuccugauucccgagccggaucggcagagaaccccucaagacaaucagcuggccuaugucgugaucggacuccuuuuuaugauucugacagucgcugcgaacgaaaugggccugcucgagacgaccaaaaaggaucuggggaucggacacgccgcugccgagaaccaccaucacgccgcuaugcuugacguggaucugcaucccgccuccgcguggacacucuacgccguugcuaccacaauuaucaccccuaugaugcggcacacgauugaaaauaccacagccaacaucagccugaccgcuaucgccaaucaggcggccauucugaugggccucgacaagggcuggcccaucucuaaaauggauauuggggugccucuucuggcucugggaugcuacagccaagucaacccccucacacugaccgccgcugugcuuaugcugguugcccauuaugcuaucauuggcccggggcuccaggccaaggcgacgcgcgaggcccagaaaagaacagcugccggaaucaugaagaauccuaccguggacggcaucgucgcuauugaucuggaccccgugguguacgacgccaaauucgaaaagcagcuggggcaaaucaugcuccuuauucuguguacaucccagauccugcucaugcggaccaccugggcccugugcgagucuauuacacuugcgacgggaccccugaccacacucugggaaggcagcccuggcaaguuuuggaacaccacaaucgcuguuuccauggccaauaucuuccgcgggagcuaucuggcuggagccggccuggccuuuucccucaugaaaucucuugggggaggcagacgggggaccggagcucagggcgagacgcugggcgagaaguggaaacgccagcugaaccaacucagcaaguccgaguucaauacauacaaaagaucugggauuaucgaggucgaucggagcgaagccaaggagggacugaagcgcggcgaaaccaccaaacacgcgguguccagagggacagccaaacuucggugguucguggagagaaaccuggucaaaccggagggaaagguuauugaccucggcugugggcgcggaggcuggucuuauuacugcgcuggccugaaaaaggugaccgaagugaaaggguauacaaagggaggccccgggcacgaggaaccuauccccauggccacguacggauggaaucuggucaagcuccauagcggcaaagauguguuuuucauuccucccgagaagugugacacccuucugugcgauaucggggaauccagcccuaacccgacaauugaggagggacggacccugagaguucucaaaaugguggaacccuggcugcgcggcaaucaguuuuguaucaagauccuuaacccuuacaugcccucugucguggagacacuggaacagaugcagcggaaacacggcgggaugcucguuagaaauccucugucccgcaacagcacccaugagauguauugggugucuugcggaacgggcaauauugucuccgcugugaacaugaccagccggaugcugcucaacagauucacaauggcccaccgcaagcccaccuacgagcgggacguggaucugggggcgggaacaagacacgucgccguugaaccggagguggcuaaucuugacaucauuggccaacgcaucgaaaacauuaagaaugagcauaaaucuaccuggcacuaugaugaagacaacccuuacaagacaugggccuaucauggguccuacgaggugaaacccagcggauccgcuagcucuauggucaauggcgugguucggcugcucaccaagcccugggaugugaucccuauggucacgcagaucgccaugacagacaccacccccuuuggccagcaaagaguguucaaagagaagguugacacacgcacgccuaaggcuaaaagagggaccgcccagauuauggaagugacagcgaaguggcuguggggauuucuuagccggaacaaaaagccgcgcaucuguaccagagaggaguucacacggaaagucagauccaaugccgcuauuggcgccguguuuguugaugagaaccaguggaacucugcuaaggaagccguggaggacgagcgguucugggaucugguccgcagagaacgggagcuccacaagcaggggaaaugcgcgaccugcguguauaacaugaugggaaagcgcgagaaaaagcugggcgaguuugggaaagcgaagggcagcagagcuaucugguacauguggcugggagcccgguuccucgaauuugaggcccugggcuucaugaaugaggaccauugguucucccgcgaaaacucucuuagcggggucgagggagaaggccugcacaaacucggguacauucugagagauaucuccaagauccccggaggcaauauguaugcugacgauacagccgggugggacacccggauuacggaggaugaccuucaaaacgaggcuaagaucaccgauauuauggaaccugagcacgcccugcucgcgacaucuaucuuuaaacugaccuaccagaauaaggugguucgcgugcagagacccgccaaaaacggcacagucauggacgugauuagccggcgcgaucagagaggauccggccaaguggggaccuauggacugaacacguucacaaauauggaagcucagcucauccggcagauggagagcgaaggcaucuuuucuccuuccgagcuggagacccccaaccuugccgggcgcguucuggacuggcucgaaaagcauggaacagagagacugcggagaauggcuauuagcggcgacgauuguguggucaaaccgaucgacgaucgcuucgccaccgcgcuuacggcccugaaugacauggggaagauucggaaggauaucccucagugggaacccucuaaaggcuggaacgacuggcaacaggugccuuuuugcucccaccauuuccaccagcucauuaugaaggauggaagagagaucguugugcccugucgcaaucaggacgaacuggucggccgggcuagagugagccaaggggccggauggucccugcgcgagaccgcuugccucggcaaaucuuacgcccagauguggcagcugauguauuuucaccggagagaucuucgccuggcugccaacgcgauuuguagcgccgucccuguggacuggguucccacaucccggaccacauggagcauccaugcucaccaucaauggaugaccacagaggauaugcucucuguguggaauagagucuggaucgaagagaacccguggauggaagacaagacccacguguccagcugggaggacguuccuuaccuggggaaacgcgaagaucaguggugcggaucucuuauuggccugacggcccgggccacaugggcuaccaauauccagguggccauuaaccaggucagacggcucaucgggaaugagaacuaucuggacuacaugaccagcaugaagagauucaagaaugaguccgaucccgaaggcgcgcugugguga

SEQ ID NO: 18450 - RNA, 9879 nt, Artificial Sequence
  derived and/or modified CDS sequence (opt5) from DENV-1__AB189121__SS-prME
agcgugaccaugcuguucaugcuccugcccacagcccuugcuuuucaccugacgaccagaggcggggaaccucauaugaucgucuccaagcaggaacggggaaaaucucuccuguucaagaccagcgccggcguuaauaugugcacccuuauugcgauggaccugggggaacucugugaagauacaaugaccuacaaaugcccgcgcaucacagagaccgaacccgacgauguggacuguuggugcaaugcuacggagaccugggugacauauggaaccuguucccaaacaggcgagcacagacgggauaagcgcucugucgcccuggccccucauguggggcugggacucgaaaccagaacggagacauggaugagcuccgaaggcgcuuggcggcagauucagaaaguugagaccugggcccugcgccaccccggcuuuacagugauggcucuuuuccuggcccaugcgaucgggaccucuauuacccagaagggaaucaucuuuauucuccugaugcuugucacaccuagcauggccaugagaugcgugggcaucgggaaccgggacuucguugagggacuguccggcgcuacguggguggaugucgugcucgaacacgggagcugugugaccacaauggccaaggacaaacccacccuggauauugagcugcucaagacagaagucaccaauccugcuguucugcgcaaacuuugcaucgaggccaagauuucuaacacgacaaccgacuccagauguccgacccaaggagaagcgacacugguggaggagcaggauaccaauuuugugugccggcgcacauucgucgacagaggcuggggcaacggguguggacucuuuggcaaagggagccugaucacgugcgccaaguucaagugcgugaccaaacuugaaggaaagauuguucaguacgagaaucugaaauauucugugaucgucacagugcacaccggcgaucagcaucaaguugggaacgaaacaaccgagcacggaacgaccgcuaucauuacaccccaggccccuaccuccgaaauccagcucacagacuacggcgcucugacccuggacuguagcccccggacgggccucgauuuuaaugagauggugcugcuuacaaugaaggagaaaucuuggcugguccauaagcagugguuccucgaccugccucuucccuggaccuccggggccagcacaucccaagaaaccuggaaccgccaggaucugcucgugaccuuuaaaacagcccacgcuaagaagcaggaggucgugguucugggaucucaagaaggcgcgaugcacacggcccugaccggggcuacagagauucagaccagcggaacaaccacgaucuucgccggccaucucaaaugcagacugaagauggacaaacuuacacugaaggggguguccuaugucauguguaccggcagcuucaaacucgaaaaggagguggccgagacccagcacggaacaguucuggugcaggucaaguacgaaggcaccgaugcuccgugcaaaauuccuuuuucuucccaagacgagaagggggugauccagaauggacggcugaucacagccaaccccauugugacggauaaagaaaagccuguuaauaucgaggcggagccgcccuucggcgaaagcuauauugucgugggggcuggagagaaagcccuuaagcucucuugguuuaagaaaggcagcuccaucgggaagauguucgaagccaccgcuagaggcgcccgccggauggcuauucugggagacacagccugggauuuuggcucuaucgggggaguguucaccagcgucggcaaacuggugcaucagaucuuugggacagcguacggaguucucuucuccggcgugagcuggaccaugaagauugggaucggcauucugcuuacguggcugggacucaacucuagauccaccagccugucuaugacauguaucgccgucggcauggugacccuguaccuugggguuauggugcaggcugacuccggaugcgucauuaauuggaaaggccgcgagcucaagugugggagcggaaucuuugugacaaacgaaguucacaccuggacagagcaauauaaguuccaggccgauuccccuaaacggcugucugcugccauuggcaaggcgugggaggaaggggugugcggcaucagaagcgccacccgccuggagaacaucauguggaaacagauuuccaaugaacucaaccauauccugcuugagaaugacaugaaguuuacggucguggugggagacgucucuggcauucuggcucaggggaaaaagaugauccggccgcaacccauggaacacaaauacagcuggaaguccuggggaaaggccaaaauuaucggcgcugauguucagaacaucacauucauuaucgacgggccuaauaccagcgagugucccgauaaccagagagccuggaauauuugggagguggaagacuauggauuuggcaucuucaccacaaacauuuggcucaagcugcgcgauucuuacacccaggugugcgaccaccggcugauguccgccgcuaucaaagauagcaaggcgguccaugccgacaugggcuauuggaucgagucugagaagaaugagacguggaaacuugcuagagccuccuucauugaagugaagacauguaucuggccuaaaagccacacccucuggucuaacgggguucuggagagcgagaugauuauccccaagauuuacggaggcccggugucccaacauaauuaucgcccuggguacuuuacacagaccgccggacccuggcaccugggcaaacucgaacuggauuucgaccuuugcgaggggacaaccgucgugguugaugaaaacugcggaaaucggggcccuagccugagaacgaccacagugaccggcaagacaauccacgagugguguugccggucuuguacccugcccccucugcgcuuuaaaggggaggacggaugcugguacggcauggaaaucagacccgucaaggagaaggaagagaaccuggugaaauccaugguuagcgcuggguccggagaaguggauucuuucagccuuggccuccuguguauuuccaucaugauugaggaggucaugcggucuagauggagccgcaagaugcugaugacggggacacucgccguguuucugcuucugaccaugggacagcucacauggaaugaccugauccggcugugcauuauggugggcgcgaacgcuuccgacaugaugggcauggggaccaccuaucuugcccugauggccacauucagaaugcgcccgauguuugcugucggacuccuguucagacggcucacgucucgcgaaguucugcuucugaccgugggccucagccugguggccuccgucgagcugccuaacagccuugaagaacucggggauggacucgcgaugggcaucaugaugcugaaacuccugacagacuuucaaccccaucagcuuugggcuacccugcucucucugacauucgugaagaccacguuuucccugcacuacgccuggaaaacaauggccaugauucuuagcaucguuucucugcucccccugugucucuccaccaccagccagaagacaaccuggcugccugugcuucuggggucucugggaugcaagccgcucacaaugcugcuuaucacggaaaauaaaauuuggggcagacgguccuggccccugaacgagggcaucauggcuauugggaucgucagcauucuccuguccagccuccugaagaaugaugugccucuugccggaccccugaucgcuggcgggaugcugaucgccuguuauguuauuucuggaagcuccgcggaccucucucuggagaaagccgcugaagugagcugggaggaugaagccgagcauuccggcgcuucucacaacauccuugucgaagugcaggacgaugggaccaugaagauuaaagacgaggagcgcgaugacacacugaccauccuccugaaggccacacuccuggccauuagcggagucuacccuauguccauccccgcuacccuuuucgugugguauuuuuggcagaagaagaagcagagaucuggcguucugugggauacgccuagcccucccgaaguggagcgggcgguccuggacaauggcaucuaccgcauucuccagagagggcugcuuggacggucccaggugggcguugggguguuccaagaaggagucuuccauaccauguggcacgugacacgcggcgccgugcugauguaucaggggaaaagacucgagcccagcugggcuucuguuaagcgggaucugaucuccuacggaggcggcuggagauuucaggggagcuggaacaccggagaggaaguccaggugauugccguggagcccggcaaaaauccuaagaacguccaaacaacccccgggacauucaaaacgccggaaggagaggugggcgccaucgcucucgacuuuaagccugggaccucuggaucccccauuguuaaucgcgaaggcaagaucgugggccuguacgggaacggagucgugacaaccagcggcaccuauguuuccgccauugcgcaggcuaaagccucucaggaggggccucuucccgagaucgaagacgagguguuccggaagagaaaucugacaaucauggaucugcaccccggaagcggcaaaacgcgccgguaccucccugccauugucagagaagcuaucaagcgcaaacugcggacccuugugcuggccccgacaagaguuguggcguccgagauggcugaagcccucaaggggaugcccauucgcuaucaaaccacagccgucaagagcgagcauaccggcaaagagaucguggaccugaugugccacgcuacguuuacaaugcggcugcucucuccugugagaguccccaacuacaauaugauuaucauggaugaagcccauuucaccgacccugcuuccaucgccgcgcggggauauauuagcacccgcguuggcaugggggaggccgcugccaucuuuaugacagcuacacccccuggaucuguggaagccuucccgcagagcaacgccgugauucaggaugaggaaagagacauccccgagcgguccuggaacucuggcuacgaguggauuacagauuuuccugggaagaccgucugguucgugcccagcaucaaauccggaaacgacaucgcuaacugucuucgcaagaauggcaaaagaguugugcagcugucucggaagacguuugauacagaauaucaaaagaccaaaaacaaugacugggauuacgucgugacaaccgacauuagcgagaugggggcgaacuucagagccgaccgcguuaucgauccucggagaugccugaagcccgugauucucaaagacggcccggaacgcgucauccuggcuggaccuaugcccgugacggucgccuccgccgcucagcggagaggccgcauugggcggaaucccaacaaggagggagaucaguacguguauaugggccagccucuuaauaacgacgaggaucacgcccauuggaccgaagcgaaaaugcugcucgacaauaucaacacacccgaggggauuaucccugcucuguucgaaccggagagagaaaagagcgccgccaucgauggagaguaccgccugagaggcgaggcucggaagaccuuuguugaacucaugcgcagaggggaccuucccguguggcugucuuauaaaguggccuccgagggcuuccaauacagcgaucggcgcuggugcuuugacggagaaagaaauaaccagguccuggaggaaaauauggauguugagauuuggacaaaggagggcgaacggaaaaagcucagaccucgcuggcuggacgcgcggaccuauuccgauccccuugcccugagagaguucaaagaauuugcugccgggcgccggucugugagcggagaccucauccuggagauuggcaagcugccucagcaccucacacagaaagcucaaaacgcccuugacaaucuggugaugcugcacaacuccgaacaagggggaaaggcuuacagacaugccauggaggagcuccccgauaccaucgaaacgcugaugcuucuggcgcucauugccguccugacaggcggcgugacccuguucuuucucucugggcggggacuuggcaagaccagcaucgggcugcuguguguuauggcuuccagcgcccuccuguggauggcuucuguggagccgcacuggaucgccgccuccauuauccuugaguucuuucugaugguccuccugauuccugagcccgaccgccagagaacaccucaggauaaccagcuggcuuauguggucaucggacuccuuuucaugauucugaccguggcggccaaugagaugggccugcucgaaacaacgaaaaaggaccuggggaucggacaugcugccgccgagaaccaccaccaugcugccaugcuugauguugaccugcaccccgcgagcgccuggacccucuacgcuguggccacaaccaucauuacaccuaugaugcggcauaccaucgaaaauacgaccgcuaacauuucucugacagccaucgcgaaucaggccgcuauucugaugggccucgauaaaggcuggcccaucuccaagauggacauuggggucccgcuucuggcccugggaugcuacagccaggugaacccucucacccugacagcugccguucuuaugcugguggcucacuaugccaucaucggccccgggcuccaagcgaaagccacccgcgaggcucagaagagaacggccgcuggaauuaugaagaaucccacagucgauggcaucguggccauugaccuggauccugugguuuacgacgccaaauuugaaaagcagcuggggcagaucaugcuccuuauucuguguaccucucaaauccugcucaugcggacaaccugggcgcugugcgagagcaucacccuugcuacaggaccgcugacgacccucugggagggcucccccggcaaauucuggaacacaaccauugccgucucuauggcuaauaucuuucgcgggagcuaucuggccggagccggccuggcuuucucccucaugaaaagccuugggggaggcagacgggggacaggagcccagggcgaaacccugggcgagaaauggaagcgccagcugaaccagcucuccaagucugaguucaauauuuacaaaagaagcgggaucauugagguggaucgguccgaagcgaaggagggacugaaaagaggcgagacgacaaagcaugccgugucucgcgggaccgcuaaacuucggugguuugucgaaagaaaccugguuaagccugagggaaaggugaucgaccucggcugugggcgcggaggcuggagcuauuacugcgccggccugaaaaaggugaccgaagucaaaggguauacaaagggaggccccgggcacgaggaaccuauccccauggcuaccuacggauggaaucuggugaaacuccacuccggcaaggacguuuucuuuacaccuccggagaaaugugauacgcuucugugcgacauuggggagucuagccccaacccuaccaucgaagagggacggacacugagagugcucaagauggucgaacccuggcugcgcggcaaucaauucuguauuaagauccuuaacccuuacaugcccuccgugguugagacccuggagaaaaugcagcggaagcauggcgggaugcucgugagaaauccgcugagccgcaacucuacacacgaaauguauugggucuccugcggaaccggcaacauugugagcgccgugaauaugacgucucggaugcugcucaacagauuuaccauggcgcaucgcaaaccuacauacgagcgggaugucgaccugggggccggaaccagacacguugcuguggaacccgagguggccaaucuugauaucauuggccagcgcaucgaaaacaucaagaaugagcacaaauccacauggcauuaugacgaggauaaccccuacaagaccugggcuuaucacgggagcuacgaagucaagccuucuggauccgccagcuccauggugaauggcguugugagacugcucacaaaacccugggacgucauuccuauggugacccagaucgcuaugacggauacaaccccguucggccaacagcggguuuuuaaggagaaaguggacacccgcacacccaaggccaaaagagggacggcgcagauuauggaagucaccgcccgguggcuguggggauuccuuagcagaaacaagaagccucggaucuguacacgcgaggaauuuaccagaaaagugcggucuaaugcugccauuggcgcuguuuucguggaugagaaccaauggaauagcgccaaggaggccgucgaagacgagcgcuuuugggaccuggugcauagagaacgggagcuccacaaacaggggaagugcgcgacaugcgucuauaacaugaugggaaaacgcgaaaagaagcugggcgaguucgggaaagcuaagggcuccagagccaucugguacauguggcugggagcccgguuucucgaguucgaagcucugggcuucaugaaugaggaucauugguuuucucgcgaaaacagccuuuccgggguggagggagagggccugcacaaacucggguacauccugagagacauuucuaagauccccggaggcaauauguaugccgaugacaccgcugggugggauacacggauuaccgaagacgaucuucagaacgaggccaaaaucacggacauuauggaaccugagcacgcgcugcucgccaccagcaucuucaagcugacauaccagaacaaaguugugcgcguccaaagacccgcuaagaauggcaccgugauggaugugaucucccggcgcgaccagagaggaucuggccagguugggacauauggacugaacaccuuuacgaauauggaagcccagcucauucggcaaauggagagcgagggcaucuucuccccgagcgaacuggagacaccuaaccuugcugaaagaguguuugauuggcuggagaagcaugggauugaacgccucaaacggauggccaucucuggagacgauugugucgugaagcccauugacgacagauucgcgaccgcccugacagcucuuaaugauaugggcaaaguucgcaaggacaucccucagugggagcccuccaaaggguggaacgauuggcaacaggugccuuuuugcagccaccauuuccaccaacugaucaugaaggacggccgggagauugucgugcccuguagaaaucaggaugaacucgucggacgcgcccgggugucucagggcgcuggguggucccugagagagaccgccugccugggaaagagcuacgcucagauguggcaacucauguauuuucaccgccgggaccugagacuugccgcgaacgccaucuguuccgcuguuccgguggauugggucccuacgucucgcaccacauggagcauucaugcccaccaucaguggaugaccacagaagacaugcuguccguguggaaucggguuuggaucgaggaaaaccccuggauggaggauaaaacccacgugagcucuugggaggacguccccuaccucggcaagagagaagaucaguggugcgggucccugauuggacuuacagcccgggcuaccugggccacgaauauccaaguggcgauuaaccaggugagacgccugaucggcaaugagaacuaucucgacuacaugacaagcaugaaacgguucaagaaugaaucugacccugagggggcucugugguga

SEQ ID NO: 18451 - RNA, 9879 nt, Artificial Sequence
  derived and/or modified CDS sequence (opt5) from DENV-1__AB195673__SS-prME
agcgugaccaugcugcucaugcugcuucccacagcucugacguuccaccucaccacacggggaggggagccucauaugaucgucggaaagcaggaacggggaaaaucccugcuuuuuaagaccucugcugggguuaacaugugcacacugauugccauggaccucggagagcugugugaugacaccaugacauacaaaugcccgcgcaucaccgaaacggagcccgaugacguggauuguuggugcaaugcgaccgaaacaugggugaccuauggcacauguagccaaaccggggagcaccggcgggacaagcgcuccgucgcucuggccccucaugugggacucggccuggagacgagaacagaaaccuggaugucuagcgagggcgccuggcggcagauucagaaaguugaaacaugggcccuucgccaccccggguucaccgugaucgcccuguuucucgcucaugucauuggaaccuccaucacacagaagggcaucauuuucauccugcuuaugcuggugacgccuucuauggccaugagaugcguugggauuggaaaccgggauuuuguggagggccucagcggggcgaccugggucgacguggugcuggagcacggauccugugucacaaccauggccaaggauaaacccacacuggacaucgaacuccugaagaccgagguuacgaauccugcugugcuucgcaaacugugcauugaagccaagaucagcaacacaaccaccgauucuagauguccgacacaaggcgaggcuacccucguggaagaacaggacacaaauuucgucugccggcgcacguuuguggauagaggcugggggaacggauguggccuguucgggaaaggaucccuuauuaccugcgccaaguuuaagugcguuacaaaacuggagggcaagaucgugcaguacgaaaaucucaaauauagcgucaucgugaccguucacacaggggaccagcaucaagugggaaacgagaccacggaacacggcaccauugcgacaaucacaccccaggccccuacaucugagauucagcugaccgacuacggcgcucugacgcucgauuguagcccccggacagggcuggacuucaaugaaaugguccuucugaccaugaaggagaaaagcuggcucgugcauaagcagugguuucuggaucuuccucugcccuggacaucuggagccuccaccagccaagagaccuggaaccgccaggaccuccuggucacauucaaaacggcucacgccaagaagcaggaagugguugugcugggcucccaagagggggccaugcacaccgcucucacaggagcgaccgaaauccagacaucuggcaccacgacaauuuuugccgggcaucugaaaugcagacuuaagauggauaaacugacccucaagggcaucagcuaugucauguguaccggauccuucaaacuggagaaggaaguggcugagacacagcacggcaccguucuggugcaggucaaguacgaggggacagacgccccgugcaaaaucccuuucagcucucaagaugaaaagggagugacgcagaauggccggcuugugaccgccaaccccauuguuacagacaaagagaagccugucaauaucgaagcugagccgcccuuuggggaguccuauauuguggugggagccggcgaaaaagcgcucaagcugagcugguucaagaaagggucuagcaucggcaagauguuugaggcuaccgccagaggagcccgccggauggcuauucugggcgauacagccugggacuucggguccaucggaggcgucuuuaccucuguggggaaacucguucaucagaucuucggaacggcuuacggcgugcuguuuagcggggucuccuggaccaugaagauuggcaucggcauucuucugacauggcucggccugaacagcagaucuaccucccugagcaugacauguaucgccguggggcuuauuacccucuaccugggaguuauggugcaggcggauucuggcugcgucaucaauuggaaagggcgcgaacugaaguguggauccggcauuuucgugacaaacgagguucacaccuggacggaacaauauaaguuucaggccgacagcccuaaacggcucuccgcugccaucgggaaggcuugggaggagggcgugugcggaaucagaucugccacacgccuggaaaacauuauguggaaacagaucagcaaugagcuuaaccauauucugcucgaaaaugacaugaaguucaccgucguggugggcgaugucuccgggauccuggcgcagggcaagaagucuauucggccgcaacccauggagcacaaauacagcuggaaguccuggggcaaggccaaaaucaucggggcugacguucagaacaccacauuuauuaucgauggaccuaauacccccgaauguccugacgaucagagagccuggaacauuugggagguggaggacuauggcuucggcaucuuuacgacaaauauuuggcugaaacuucgcgauagcuacacccaggugugcgaccaccggcucaugucugcugccaucaaagauuccaaggccguccaugcugacaugggguauuggaucgaaagcgagaaaaacgaaacauggaagcuggcgagagccucuuucauugaggugaagaccuguaucuggcccaaaucccacacacuguggagcaauggaguucucgaaucugagaugauuaucccgaagauuuacggcgggccuaucagccaacauaacuaucgccccggauacuucacccagacggcuggcccuuggcaccuggggaaacuugagcuggauuuugaccucugcgaaggaaccacaguggucguggaugagcacugcggcaaucggggccccucccugagaaccacaaccguuacggggaagaucauucaugaaugguguugccggagcuguacacugccuccccuucgcuucaaaggagaggacggcugcugguacgggauggagaucagaccggugaaggaaaaggaggaaaaccucgucaaaucuaugguguccgccggaagcggcgagguugacuccuuuucucuggggcugcucuguauuagcaucaugauugaagaggugaugcgguccagauggucucgcaagaugcugaugaccggaacacuugccgucuuccugcuccugaccaugggccagcugaccuggaaugaucuuauccggcugugcauuauggugggcgcuaacgccagcgacaauauggggaugggaacaacguaucucgcgcugauggcuaccuuuagaaugcgcccuauguucgccgugggccuccuguuuagacggcuuacaucccgcgagguccugcuccugaccguugggcugucucuuguggccagcguggaacugcccaacucccucgaggaacugggagauggccucgcuauggggaucaugauccugaaacuucugacagacuuccaaagccaccagcucugggccacccugcugucucuuacguuugucaagacaaccuucucccugcauuacgcguggaaaaccauggcuaugauucucagcaucgugucucuguuuccccucugucuguccacaaccagccagaagacaacguggcuuccuguucugcugggaucucucggcugcaagccgcugaccauguuccuuauuacagagaacaaaaucuggggcagaaaguccuggccccugaaugaagggauuauggccgugggaaucgucagcauccuccuguccagccuccugaaaaacgaugugccucuugccggcccccugauugcugggggaaugcugaucgccuguuauguuauuucuggcagcuccgcugaccucucucuggagaaggccgcggaggugagcugggaagaggaagccgagcacuccggggcuucucauaauauccuugucgaaauucaggaugacggaaccaugaaaaucaaggaugaggagcgggacgauacaaucaccauucugcucaaagccacgcugcucgcuaucagcggcguguacccuauguccauucccgccacccuguuugucugguauuucuggcaaaagaagaaacagcgcucuggcgugcuuugggacacaccuuccccucccgaaguugagagagccgugcuggaugacgggaucuaccggauucugcagcgcggacuccugggcagaucccaggucggggugggaguuuuccaagaaggcguguuucacaccauguggcacgucacaagaggggcugugcuuauguaucagggaaagcgccuggagcccagcugggcgucugugaaaaaggaccucaucuccuacggcggcggguggagauuccagggaagcuggaacaccggcgaggaaguucaggucauugccguggagcccgggaaaaauccuaagaacgugcaaacagcucccggaacguuuaagaccucugaaggcgaggucggggccaucgcccuggauuucaaaccgggaacauccggcagcccuaucgugaaucgggaaggcaagauuguugggcucuacggaaacggcguggucaccaccuccgggacauaugugucugcuaucgcccaggcgaaagcuagccaggagggaccccugccugagauugaagacgagguuuuuagaaagcgcaaucuuacgaucauggaucugcaucccggcuccgggaaaacccggagauaccugcccgccauugugcgcgaagccaucaagcggaagcucagaacacugguccuugcuccuacccgcgugguugccagcgagauggcggaagcucugaaaggcaugccgauccgguaucaaacaaccgccgugaagucugagcacacgggaagagagauugucgaccucaugugccaugccacauucaccaugcgccugcugucccccgugcgggugccuaacuacaauaugaucauuauggaugaagcucacuuuaccgaccccgccagcaucgcugccagaggcuauauuucuacacgggucgggaugggagaggcggccgcuaucuucaugaccgccacaccucccggcagcguugaggcuuuuccucaguccaacgccgugauccaggaugaggaaaaagacauuccggagcgcucuuggaauagcggguacgauuggaucaccgacuuccccggaaagacggugugguuugucccuuccauuaaaucuggcaacgauaucgccaauugucucagaaagaacgggaagcgggugauucagcuuagccgcaaaacauucgacaccgaguaucaaaagaccaaaaauaaugacugggauuacguugugaccacggacaucuccgaaaugggcgcuaacuucagagcggaucgggucauugaccccagacgcugccugaagccugugauccugaaagauggacccgagcggguuauccucgccggcccgaugccugugaccgucgcuagcgccgcccagagacgcgggcggauuggaagaaaucagaacaaggaaggcgaccaguacaucuauauggggcaaccccugaauaacgaugaggaccaugcucacuggacagaggccaagaugcuucuggauaauauuaacacccccgaaggaaucauuccugcgcucuuugagcccgaacgcgagaaaucugcugccaucgacggcgaauaccggcugagaggggaggcccgcaagacauucguggagcugaugagacggggcgaucucccugucuggcuuuccuauaaaguggcuagcgaaggauuucaguacuccgaccgcagauggugcuucgauggcgagcggaauaaccagguucuggaagagaauauggacguggaaaucuggaccaaggagggggagcgcaaaaagcugagaccgcgguggcucgacgccagaacauauucugauccccuggcgcuucgcgaauuuaaagaguucgccgcuggacggagaagcguguccggcgaccugauucucgaaaucgggaagcugccucagcaccugacccaacgcgcccagaacgcucucgauaaucuugucaugcugcauaacucugagcagggaggcaaggccuaccggcacgcuauggaggaacugcccgacacgauugagacacucaugcugcuugcccugaucgcgguucucaccggcggggugacccuguuuuuccugagcggaagaggccucgggaaaacauccauuggacuucugugugugauguccucuagcgcccugcucuggauggcuagcgucgaaccucauuggaucgccgcuucuaucauucuggaguuuuuccuuauggugcugcucauccccgaaccggaucggcagcgcaccccucaagacaaucagcuggccuauguugugauuggccugcucuuuaugauccuuacagucgccgcuaacgagauggggcugcuggagacgaccaagaaagaucucggaauuggccacgcggccgcugaaaaccaccaucacgccgccaugcuggacguggaucuucaucccgcuuccgccuggacacuguacgcggucgccaccacaaucauuaccccuaugaugagacacacgaucgagaauaccacagcuaacaucagccucaccgccauugcuaaucaggccgcgauccugaugggccuggacaagggguggcccauuucuaaaauggauaucggagugccucuccuugcccugggcugcuacagccaaguuaacccccugacacucaccgcugccgugcugaugcuugucgcucauuaugccauuaucgggccgggacugcaggcuaaggccacgcgggaagcgcagaagcgcacagccgcuggcaucaugaaaaauccuaccguggacgggauuguugccaucgaucucgaccccguggucuacgacgcuaaguucgagaaacagcugggacaaauuaugcugcucauccuuuguacaucccagauucugcugaugagaaccaccugggcccucugcgaaucuaucacacuggccacgggcccccuuaccacacugugggagggcagcccugggaaguuuuggaacaccacaaucgcgguguccauggcuaauauuuuccggggaagcuaucucgccggcgcugggcuggccuucucccugaugaaaucucucggaggcgggcgcagaggaaccggcgcccagggcgagacgcuuggggaaaaguggaagcggcagcugaaccaacugagcaaauccgaguuuaauaucuacaagcgcucuggaauuguggaaguugauagaagcgaggcuaaagaaggccucaagagaggggaaacaaucaaacacgccgucuccagaggaaccgcgaagcugcgcugguucguggagcggaaccuugugaagccggaaggcaaagucauugaccugggguguggaagaggcggcuggucuuauuacugcgccgggcucaagaaaguuaccgaggugaagggauauacaaaaggcgggcccggacacgaggagccuauccccauggcuaccuacggcuggaaucuggugaagcuguacagcgggaaagaugucuuuuucauuccucccgaaaagugugacacacuccuuugcgauaucggagaguccagcccuaacccgacgaucgaggaaggccgcacccugcgggugcugaagaugguugagcccuggcucagaggcaaucaguuuuguauuaaaauccugaacccuuauaugcccucuguggucgaaacacuugagcagaugcagcgcaagcaugggggaaugcuggugcggaauccucucuccagaaacagcacccacgagauguacuggguuucuugcggcacagggaauauuguguccgccgucaacaugaccagccgcaugcugcugaaccgguucacgauggcucauagaaaacccaccuaugaacgcgacguggaucucggagccggcacacggcacguggcggucgagccggaaguugccaaucuggacaucauugggcaaagaaucgagaacaucaagaaugaacacaaaucuaccuggcauuacgaugaggacaacccuuauaagacaugggcuuaccacggauccuaugaggugaagcccagcggcuccgccagcucuauggugaauggcgucgugcgccuucugaccaaacccugggauguuauuccuauggugacacagaucgcuaugaccgacacgacacccuuugggcagcaaagagucuucaaggaaaaaguggacacccggaccccuaaggccaaacgcggaacagcucagauuauggagguuacggccaaguggcucuggggcuuucugagcagaaacaagaaaccgcggaucuguaccagagaagaguucacacggaaggugcgcuccaaugcggccauuggggcugucuuuguggaugaaaaccaguggaacucugccaaagaggcuguugaggacgaaagauucugggaucuugugcggcgcgagagagaacugcauaagcagggaaaaugcgcuaccugcgucuacaacaugaugggcaagcgggagaagaaacucggggaauuuggcaaggccaaaggaagccgcgcgaucugguacauguggcugggcgcuagauuccuggaguucgaggcccucggguuuaugaaugaagaccacugguucucccgggagaacucucugagcggaguggaaggcgaggggcuucauaagcugggauauauccuccgcgauauuuccaaaauccccggcgggaauauguacgccgacgauacagcuggcugggacaccagaauuacagaggaugaccugcaaaacgaagccaagaucaccgauauuauggagccugaacacgcccuucuggccacgucuaucuuuaaacucaccuaucagaauaaggucgugcggguucagcgccccgcgaagaacggaacagugauggacgucaucagcagacgggaucagcgcggcuccgggcaagugggaaccuacggccugaacacauucaccaauaugggggcccagcugauuagacagauggagagcgaaggaaucuuuucuccuuccgagcucgagacgcccaaccuggcuggccgggugcuugacuggcuggaaaaacacgggauugagagacuccgccggauggccaucagcggcgacgauuguguugugaagccgauugacgauagauucgcuacagcccugaccgcgcuuaaugacaugggaaaaguccgcaaggauaucccucagugggaacccucuaaaggcuggaacgacuggcaacaggugccuuuuugcucccaucacuuccaucagcugauuaugaaggaugggcgggagaucguugugcccuguagaaaucaggacgaacucgucggacgcgcccgggugagccaaggcgcuggguggucccugagagagacagccugccugggaaagucuuaugcucagauguggcagcucauguacuuucaccgccgggaucugagacuugccgcuaacgccaucuguagcgcggucccuguggacuggguucccaccucccgcacgaccuggagcauucacgcccaucaccaauggaugacaaccgaggauaugcugucuguguggaaucgggucuggaucgaagagaacccguggauggaagacaaaacacauguguccagcugggaggacguuccuuaucucggcaagagagaagaucaguggugcgggucucugauuggccuuaccgcucgggccacaugggccaccaauauccagguggcuauuaaccaggucagacgccugaucggaaaugagaacuaccucgacuacaugacgagcaugaaacgguucaagaaugaguccgaucccgaaggcgcccugugguga

SEQ ID NO: 18452 - RNA, 9879 nt, Artificial Sequence
  derived and/or modified CDS sequence (opt5) from DENV-1__AB204803__SS-prME
agcgugaccaugcugcucaugcugcuucccaccguccugacguuccaccucaccacaagaggcggggaaccucauaugaucguuuccaagcaggaacgggggaaaucucugcuuuuuaagaccagcgccggcgugaacaugugcacacugauugcuauggaccucggggaacugugugaagauaccaugacauacaaaugcccgagaaucaccgaaacggaacccgacgauguggacuguuggugcaaugccaccgagacaugggucaccuauggaacauguucccagaccggcgagcacagacgggauaagcgcucuguggcgcuggcuccucauguugggcucggacuggaaacgagaacagagaccuggaugagcuccgaaggcgccuggaaacagauucagaagguggagacaugggcccuucggcaccccggcuucaccgucaucgcucuguuucucgcccaugcuauugggaccucuaucacacagaagggaaucauuuucauccugcuuaugcuggugacgccuagcauggccaugcgcugcguuggcauugggaacagagacuuuguggagggacucuccggcgcgaccugggucgauguggugcuggaacacgggagcugugucacaaccauggccaaagacaagcccacacuggauaucgagcuccugaaaaccgaaguuacgaauccugcugugcuucggaagcugugcauugaggccaaaaucucuaacacaaccaccgacucccgcuguccgacacaaggagaagcuacccucguggaggagcaggauacaaauuucgucugcagacggacguuuguggaccgcggcuggggcaacggguguggacuguucggcaaggggagccuuauuaccugcguuaaguuuaaaugcgugacaaagcuggaaggaaaaaucguccaguacgagaaucucaaguauucugugaucguuaccgugcacacaggcgaucagcaucaagucgggaacgaaaccacggagcacggaaccauugccacaaucacaccccaggcgccuacauccgaaauucagcugaccgacuacggcgcccugacgcucgacuguagccccagaacaggccuggauuucaaugagauggugcuucugaccaugaaagagaagucuuggcucguccauaaacagugguuucuggaccuuccucugcccuggacauccggggcuagcaccucccaagaaaccuggaaccggcaggaucuccuggugacauucaagacggcccacgcuaagaaacaggagguugugguccugggaucucaagaaggcgccaugcacaccgcccucacaggggcuaccgagauccagacaagcggaaccacgacaauuuuugcgggccaucugaagugccgccuuaaaauggacaagcugacccucaaagggaccuccuaugugauguguacaggcccguucaagcuggaaaaggagguugccgagacccagcacggaacagugcugguccaggugaaauacgaaggcacggaugcuccuugcaagauccccuucagcucucaagacgagaaaggggugacccagaauggaagacuuaucacagccaacccuauuguuaccgauaaggaaaaacccaucaauauugaggccgagcccccuuuuggcgaauccuauaucgucgugggggugggagagaaggcucucaagcugagcugguucaaaaagggcucuagcauugggaaaauguuugaagccacagcgcggggcgcuagacgcauggccauccugggagacaccgccugggauuucggcuccaucgggggagucuuuacgucuaugggcaagcucgugcaucagauuuucgggaccgcuuacggaguucuguuuagcggcguguccuggacaaugaaaaucgggauuggcauccuucugaccuggcucggacugaacagccggucuacaucccugagcaugaccuguauugccgucggcauggugacacuuuaccucgggguuauggugcaggcugacucuggaugcgucaucaauuggaagggcagagagcugaaguguggguccggaauuuucgugaccaacgaaguucacacguggacagagcaauauaaauuucaggccgauagcccgaagcgccuguccgcggccaucggcaaggcuugggaggaaggggugugcggcauccggucugccaccagacucgagaacauuauguggaagcagaucagcaaugaacugaaccauauucuucuggagaaugacaugaaauucaccgucguggugggagacgucuccggcauccucgcucaggggaagaaaaugauucgcccccaaccuauggaacacaaguacucuuggaaaagcuggggaaaagccaagaucaucggcgcggauguucagaacacaaccuuuauuaucgacgggcccaauacgccugaguguuccgaugaccagcgggccuggaacauuugggagguggaagauuauggauucggcaucuuuacaaccaauauuuggcugaaacugagagacagcuacacacaggugugcgaucaccgccuuaugucugcugccaucaaggacucccgggcuguccaugccgauaugggcuauuggaucgagagcgagaaaaaugagaccuggaagcucgccagagcuucuuucauugaagugaagacauguaucuggcccaaaucccacacccuguggagcaaugggguucuggagucugagaugauuaucccgaagauuuacggaggcccuaucagccaacauaacuaucgccccggguacuucacgcagaccgcgggaccuuggcaccucggcaaacuggaacuugacuuugaucugugcgaggggacaaccguggucguggacgaacagugcggaaaucggggccccucccucagaacaaccacgguuacaggcaagaucauucacgagugguguugccggagcuguacccugccuccccugcgcuucaaaggggaggauggaugcugguacggcauggaaaucagaccggugaaggagaaggaagagaaccuugucaaaucuaugguguccgccgggagcggagaaguugacuccuuuucucucggccugcuguguauuagcaucaugauugaggaggugaugcgguccagauggucucgcaagaugcucaugacagggacccuggcugucuuccuucugcucaccaugggacaacugacauggaaugaccugauccggcuuugcauuauggugggcgccaacgccagcgauaaaaugggcauggggacgaccuaucuggcucucauggccacauuuagaaugcgcccuauguucgcggugggacugcucuuuagaggccugaccucccgggaaguccuucugcucacaguugggcugucucugguggcuagcguggagcuucccaauucccuggaagaacucggagacggccuggccauggggaucaugaugcucaagcugcuuaccgauuuccagagccaucagcugugggccacgcuccugucucugacauuugucaaaaccaccuucucccuucacuacgcuuggaagacaauggccaugacccugagcaucgugucucucuuuccccugugucucuccacaacgagccagaagaccacauggcugccuguucuucugggaucucugggcugcaaaccgcucaccauguuccugauuacagaaaacaagaucuggggccgcaaauccuggccccuuaacgaggggauuauggcggugggaaucgucagcauucugcucuccagccugcucaagaaugacgugccucuggcuggcccccuuaucgccgggggaaugcugaucgccuguuauguuauuucuggcagcuccgcugaucugucucucgagaaagccgcugaagugagcugggaggaagaggccgaacauuccggggcgucucacaacauccuggucgaggugcaagacgauggaaccaugaagauuaaagacgaggaaagagaugacacgaucaccauucuucugaaggccacacuccuggcuaucagcggcgucuacccuauguccauccccgccacccucuuugugugguauuucuggcagaagaaaaagcagcggucuggcguucugugggauacaccuuccccgcccgagguggaacgcgcuguccuugacgaugggauuuacagaauccugcagcggggacugcucggccgcucccaaguggggguuggaguguuccaggagggcgucuuucauaccauguggcacgugacaagaggggccgugcugauguaucagggaaaacggcuugagccuagcugggccucuguuaagaaagaccugauuuccuacggcggcggguggcgcuuccagggaagcuggaauacgggcgaagagguccaagugaucgcuguggaacccgggaagaacccuaagaauguccagaccgcgcccggaacauuuaaaaccucugagggcgaagugggggccauugcucucgacuucaagccgggaaccuccggcagcccuaucguuaacagagagggcaaaauuguggggcuguacggaaauggcgucgugacaacguccgggaccuauguuucugccaucgcccaggcuaaggccagccaagagggaccccucccugaaaucgaggaugaaguguuucggaaaagaaaccugacaauuauggaccuucaccccggcuccgggaagacccgccgguaccugcccgcgaucgucagagaggcuauuaagcgcaaacugcggacacucgugcuggccccuaccagaguuguggccagcgaaauggcugaggcccuuaagggcaugccgauccgcuaucagacgacagcggucaaaucugagcauaccggaaaggaaauuguggaucugaugugccacgcuaccuucacaaugcggcuccugucccccgugagagucccuaauuacaacaugaucaucauggacgaggcccauuuuaccgaucccgccagcauugcugcccgcggcuauaucucuacacggguugggaugggagaagcugccgcgauuuucaugaccgccacgccucccggcagcguggaggcuuuuccucaguccaaugccgugauccaggacgaagagaaagauauuccggagagaucuuggaacagcggguacgacuggaucacagauuuccccggaaagaccgucugguuugugccuuccaucaagucuggcaaugacauugcuaacugucugcggaaaaaugggaagcgcguuauccaacucagcagaaaaacauucgauaccgaauaucagaagacgaaaaacaacgacugggacuacguggucaccacagauauuuccgagaugggcgccaauuuccgggccgaccgcgugaucgaucccagacggugccuuaagccuguuauucugaaggacggacccgaaagagugauccuggcuggcccgaugccugucaccguggcgagcgccgcucagcgccgggggagaauuggacgcaaccagaauaaagagggcgaucaauacaucuauauggggcagccccucaacaaugacgaggaucacgcccauuggacagaagccaagaugcugcuugacaacaucaauacccccgagggaauuaucccugcucuguuugaacccgagcgggaaaaaucugccgcgauugauggcgaguacagacuccgcggggaggcucggaagacauucgucgaacugaugagacgcggcgaccugccuguguggcucuccuauaaaguugccagcgagggauuucaguacuccgauagacgguggugcuucgacggcgaacgcaacaaucaggugcuugaggaaaacauggauguggagaucuggaccaaggagggggaacgcaaaaagcugcggccgcgcuggcuggacgccagaacguauucugacccccucgcucugcgggaguuuaaggaguucgccgcgggaagacgcagcgucuccggcgaucuuauucuggagaucgggaaacucccucaacaccugacacagaaggcccagaccgcucuggacaaucucguuaugcuucacaacucugaacagggaggcaaagccuaccggcaugcuauggaggagcugcccgauaccaucgaaacacugaugcuccuggcccuuauugcugugcugaccggcggggugacacucuuuuuccugagcggaaagggccuggggaaaacguccaucggacuccuuugugucaugagcucuagcgcccugcuguggauggcgagcguggagccucacuggauugccgcuucuaucauucucgaauuuuuccugaugguucuucugauccccgagccggacagacaacgcaccccucaggauaaucagcucgccuauguggucaucggccugcuguuuaugauucucacaguggcugccaacgagauggggcuucuggaaaccacaaagaaggaccugggaaucggccaugccgcugcggagaaucaccaccaugccgcuaugcucgaugucgaccugcaccccgccuccgccuggacccuuuacgcuguggccacgaccauuaucacaccuaugaugcggcauaccauugaaaacacaaccgcgaacaucagccugacggccauugcuaaucaagccgcuauccucaugggccuggauaaaggguggcccaucucuaagauggacauuggaguuccucugcucgcccuuggcugcuacagccaggugaacccccugacacugaccgcggccguccucaugcugguggcucacuaugccaucauugggccgggacuucaggcuaaagccacaagagaggcucagaagcggaccgccgcgggcaucaugaaaaauccuaccguugaugggauuguggccaucgaccuggaucccgucguguacgacgcuaaguucgaaaagcaacucggacagaucaugcugcugauucucuguacaucccagauccuucugaugcgcacgaccugggcccugugcgagucuauuacacucgcuaccggcccccugacaacccuuugggagggcagcccugggaaauuuuggaacacgacaaucgccguguccauggccaauauuuucagaggaagcuaucuggcgggcgcugggcucgccuucucccugaugaagucucugggaggcgggcggcgcggaaccggcgcucagggcgaaacccucggggagaaauggaagagacaacuuaaccagcugagcaaauccgaauuuaauacauacaagcggucuggaaucauggagguugaccgcagcgaagccaaggagggccugaaaagaggggagaccacaaagcaugccgucucccggggaacggcuaaacuccgcugguucguggaaagaaaccuggugaagccggagggcaaagucaucgaucuuggguguggacggggcggcuggucuuauuacugcgccgggcugaagaaaguuaccgaagugaagggauauacaaagggcgggcccggacacgaggaaccuauucccauggcgaccuacggcuggaaucucgugaaacugcacagcgggaaggacgucuuuuucaucccucccgagaaaugugauacacugcucugcgacauuggagaguccagcccuaacccgaccaucgaagagggcagaacgcuucgcgugcugaagaugguugaacccuggcugcggggcaaucaguuuuguauuaaaauccucaacccuuacaugcccucuguggucgagacccuggagcagaugcaaagaaagcaugggggaaugcuugugcgcaauccucugucccggaacagcacacacgaaauguauuggguuucuugcggcaccgggaauauuguguccgccgucaacaugacaagcagaaugcuccugaaucgcuucaccauggcucaucggaagcccacauacgagagagauguggaccugggagccggcacccgccacguggcugucgaaccggagguugccaaccucgauaucaucgggcagcggauugaaaacaucaaaaaugagcacaagucuacguggcauuaugacgaggauaacccuuacaaaacaugggcguaucacggauccuacgaagugagacccagcggcuccgccagcucuauggugaauggcgucgugcgccugcuuaccaagcccugggacguuauuccuauggugacccagaucgcuaugacagauacgacccccuuugggcaacagcgggucuucaaagagaagguggacacaagaaccccuaaggccaaacgcggaacagcucagauuauggaaguuaccgccaaguggcuguggggcuuucucagcagaaacaaaaagccgcggaucuguacacgcgaggaguucaccagaaaagugcgguccaaugcugccaucggggcggucuuuguggacgagaaccaguggaacucugccaaggaggcuguugaagaugagagauucugggaccuggugcaucgggaacgcgagcuucacaagcaaggaaaaugcgccacgugcgucuauaacaugaugggcaagagagagaaaaagcugggggaguuuggcaaagcuaagggaagccgggccauuugguacauguggcucggcgcccgcuuccuggaguucgaagcgcugggguuuaugaaugaggaucauugguucuccagagaaaacucucucagcggaguggagggcgaggggcugcacaaacuuggauacauccugcgggacauuuccaagauccccggcgggaauauguaugcugaugacaccgccggcugggauacacgcauuaccgaagacgaucuccagaacgaggccaagaucacagacaucauggaaccugagcacgcucugcuugccaccucuauuuuuaaacugacguaccagaauaaggucgugagaguucagcggcccgcuaaaagcggaacagugauggaugucaucucccgcagagaccaacggggcagcggacaggugggaaccuauggccucaacacauucaccaauauggaagcccagcugauucgccagauggagucugaggggaucuuuuccccuagcgaacuggagacgcccaaccucgcgggaagagugcuggauuggcuugaaaagcauggcauugagcggcugaaacgcauggccaucucuggggacgacuguguugugaagccgaucgaugacagauucgcuaccgcccucacagcucugaacgauaugggcaagguccggaaagacauuccucaaugggaacccuccaagggauggaaugauuggcaacaggugccuuuuugcagccaccauuuccaccagcuuaucaugaaagacggcagagagauuguugugcccugucgcucccaagaugagcuggucgggcgggccagagugucucagggagcgggcuggagccuccgcgaaaccgccugccuggggaaguccuacgcucagauguggcaacugauguauuuucaccggagagaccuccgccuggccgcuaacgccaucuguagcgcugucccuguggauuggguucccacaucucggaccacaugguccauucaugcccaccaucaguggaugaccacggaggacaugcuuagcguguggaauagagucuggaucgaagagaacccguggauggaagauaaaacacacgugucuagcugggaggacguuccuuaccugggaaagcgcgaggaccaguggugcggcucccucauugggcugaccgcgcgggccaccugggcuacaaauauccagguggccaucaaccaagucagacgccuuauuggcaaugaaaacuaucuggauuacaugaccucuaugaagcgguucaaaaaugagagcgaccccgaaggagcccucugguga

SEQ ID NO: 18453 - RNA, 9879 nt, Artificial Sequence
  derived and/or modified CDS sequence (opt5) from DENV-1__LC016760__SS-prME
agcgugaccaugcugcucaugcugaugcccaccgcccuugcuuuccaccugacgaccagaggaggggaaccucauaugaucgucuccaagcaggaacgggggaaaucucuccuguuuaagaccagcgccggcguuaacaugugcacccuuaucgcgauggaccugggggaacucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaaguucacaguuguggucggagauguggcuggcauucucgcccaggggaaaaagaugauccggccgcaacccauggagcacaaauacucuuggaaaagcuggggaaaggccaaaauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaagcugcgcgauuccuacacacagguuugcgaccaccggcuuaugagcgccgcuauuaaagauucuaaggccgugcaugccgacaugggcuauuggaucgaauccgagaaaaaugaaaccuggaagcucgcuagagccagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgcgggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuacagaggggaggacggaugcugguauggcauggagauucggccggugaaagaaaaggaggaaaaucuuguuaagagcauggugucugcuggguccggagaggucgacagcuucucccucggccugcuguguaucucuauuaugaucgaagaggugaugagaagccgcuggucccggaaaaugcucaugacagggacccuggccgucuuuuuccuucugauuaugggacagcucacauggaacgaucugaucagacugugcauuauggugggcgccaaugcuucugaccgcaugggcauggggaccaccuaccuugcccugauggcgacauuuaagaugagaccuauguucgcugucggacuccuguuucggcgccucacgagcagagaggugcugcuucugaccaucggccucucccugguggccucugucgaacugcccaacagccuugaggaacugggggauggacucgccaugggcaucaugauucugaaacuccugacagacuuccaaucccaccagcuuugggcuacccugcucagccugacauuuaucaagaccacguucucucugcauuaugccuggaaaacaauugcuaugguucuuuccaucgugagccuguuuccccucugucugucuaccaccucccagaagacaaccuggcucccugugcugcuugggagccugggaugcaagccgcugacaauguuccucauugccgagaauaaaaucuggggccggaagucuuggccccugaacgaaggcaucauggcggucgggauuguguccauccuucugagcucccuccugaaaaacgauguuccucucgccggaccccugauugcuggcgggaugcuuaucgccuguuacgugauuagcggaucuagcgcugaccugucccuggagaaggccgccgaggucucuugggaagaggaagcugagcacagcggcgcgucccauaauauccucguggaaguucaggaugacgggacgaugaaaaucaaggaugaggagcgcgacgauacccugacaauucuucugaaagccacccuccuggcugugucuggagucuauccucucagcauccccgccacacuguuugugugguacuucuggcaaaagaagaaacagagauccggcguccuuugggacaccccuucucccccggaaguggagcgggccguucuggaugacggcauuuaucgcaucaugcagagagggcugcucggacggagccaggugggcgucgggguguuccaagaaaacguuuuucacacgauguggcacgugacccgcggagcuguccugauguaccagggcaagagacuugagccuuccugggccagcgugaaaaaggaccugauuucuuacgggggaggcuggcggcuccagggcuccuggaauacaggggaggaagugcagguuaucgcggucgagcccggcaaaaacccuaagaaugugcaaaccgcucccggcacauucaagaccccggaaggggaggugggagccauugcccuggauuuuaaaccuggcacaagcgggucucccaucgucaacagagaaggaaagaucgugggccucuauggcaaugggguugugacgaccuccggaacauacgucagcgcuauugcccaggcgaaggcuucccaggagggcccucugcccgagaucgaagacgagguguuccgcaagcggaaccuuaccauuauggaucugcaucccgggucuggaaaaaccagacgcuaucugccugccaucguucgggaagccauuaagagaaagcuccgcacacugauccuugcuccgacgcggguggucgccagcgagauggcugaagcccugaaaggcaugcccaucagauaccaaaccacagcggugaaguccgagcacaccgggaaagagauuguugaccucaugugccaugccacauuuaccaugcgccugcugagcccugugcggguccccaauuauaacaugaucauuauggaugaagcucacuucacggacccuucuuccaucgccgcuagaggcuacauuagcacacgggugggaaugggcgaggccgccgcuaucuuuaugaccgcgacacccccugggucuguggaagccuucccgcagagcaaugcugucauccaggaugaggaacgcgacauucccgagagauccuggaacucuggauaugaguggaucacagauuuuccuggcaagaccguuugguucgugcccagcauuaaauccgggaaugacaucgccaacugucuccggaagaauggaaagcgcgugauucagcuuucuagaaaaacauuugauaccgaauaccaaaagacgaaaaacaacgacugggacuacgucgugacaaccgauaucagcgagaugggcgccaauuuccgggcugacagaguuauugauccucgccggugccugaagcccgugauccugaaagacgggccggaaagagucauccucgccggcccuaugcccgugacaguugcguccgcugcccagcgccggggaagaauuggccgcaaccauaauaaggagggggaucaguauaucuacaugggacagccccugaacaaugacgaggaucacgcccacuggaccgaagcuaagaugcuucuggacaacauuaauacgccugagggcaucauucccgcccucuucgaaccugagcgggagaaaagcgcggccaucgauggggaguauagacugcgcggagaggcuagaaagaccuuuguggaacugaugcggcgcggcgaccucccggucuggcuuucuuacaaaguggccuccgagggguuccaauauagcgauagacgguggugcuuugacggcgaacgcaacaaucagguccuggaggaaaacauggauguggagaucuggacaaaggagggagaacgcaagaaacugcggcccagauggcucgacgcucgcaccuacuccgacccucuggcccuucgggaguucaaagaauuugcugccggcagacgcucuguuagcggggaucugauucucgagaucggaaagcugccccagcaucugacacagcgggcgcaaaaugcccucgacaaccuugugaugcugcacaauuccgaacagggcgggagagcuuaucggcaugccauggaggagcugccugauaccauugaaacacucaugcugcuugcucugaucgccgugcucaccggaggcgucacgcuguucuuucugucuggcaaggggcucggaaaaacaagcauuggccuucuguguguuauggccuccagcgugcugcucuggauggcuucuguggagccccacuggaucgcggccuccaucauucuggaguucuuucuuaugguccugcucaucccggagccugaccgccagagaacaccccaggauaaccaacuggcuuacgugguuauugggcuccuguucaugauccuuaccguggccgccaaugagaugggacugcuggaaacaaccaagaaagaccucggcauugggcacgucgcuguggagaaccaucaccaugccgcgaugcuggaugucgaccuucacccugccagcgcuuggacacuguacgccguggcuacgaccaucauuacacccaugaugcggcauaccaucgaaaacacaaccgccaauaucucucucacggcgauugccaaccaggcugccauccugaugggacuggauaagggcuggccuauuuccaaaauggacaucggcguuccccuccuugcucuggggugcuauagccaggugaauccgcugacccucacagccgcuguccugaugcuuguggcccacuacgcgauuaucggaccuggccugcaagccaaggcuacccgcgaggcccagaagagaacagcugccgggaucaugaaaaaccccaccguugauggaauuguggccaucgaccucgaucccgucguguaugacgcgaaguuugaaaaacagcugggccagauuaugcugcucauccuuuguacgucucaaauucugcugaugcggacaaccugggcucucugcgagagcaucacacuggccaccgggccucuuaccacacugugggagggauccccgggcaaguucuggaauacgaccaucgcugugucuauggccaacauuuuucgcggcagcuaccucgccggggcuggacuggccuucucccugaugaaaagccucggcgggggaagacggggcacaggggcgcagggagaaacccuuggcgagaaguggaagcgccagcugaaucagcuguccaaaucugaguucaacacauauaagagaagcggcaucauggagguugaccgguccgaagccaaagaggggcucaagagaggagagaccacgaaacacgcugucucucgcggcacagccaagcugcggugguuuguggaaagaaaucuugugaagcccgaggggaaagucauugaucugggauguggccgcgggggauggagcuacuauugcgcuggccucaagaaaguuaccgaagugaagggcuacaccaaagggggaccuggccaugaggaacccgugccuauggccacauacggguggaaccuggucaagcugcacuccggaaaagacguguucuuuauucccccugagaagugugauacccuccuuugcgacauuggcgagucuagcccgaaucccacaaucgaagaggggcggacgcugagaguucugaagaugguggaaccuuggcuccgcggaaaccaauucuguauuaaaauccugaaucccuauaugccuuccgucguggagacccuugagcagaugcagcggaagcauggcggcaugcugguuagaaacccccucagccgcaauucuacacacgaaauguacuggguguccugcgggaccggaaacaucgucagcgcgauuaauaugacaucucggaugcugcugaacagauuuaccauggcccaccgcaaaccgacguaugagcgggauguggaccucggcgcugggaccagacauguggccgucgaaccugagguugcuaaccuggauaucauuggacagcgcaucgaaaauauuaagugugagcacaaauccacauggcauuacgacgaggauaaccccuauaagaccugggccuaccacggcagcuaugaagugaagcccucuggguccgcuagcuccauggugaauggagucgugaaacuucugacaaagccuugggacguuauccccauggugacccaaaucgccaugacagauaccacgccuuucggccagcagagagucuuuaaagagaagguggacacacggaccccgaaagcgaagcgcggcaccgcccaaauuauggaaguuacagcuagauggcucuggggguuccugagccggaacaagaaacccagaaucugcacgcgggaggaauuuacccgcaaggugagaucuaaugccgcuauuggagccgucuucguggacgagaaccaguggaauagcgccaaagaggcgguugaagaugagcgguuuugggaccuugugcaucgcgaaagagagcugcacaagcagggcaaaugcgcuacaugugucuacaacaugauggggaagcgggaaaagaaacucggagaguucggcaaggccaaagggucccgcgccaucugguacauguggcugggcgcuagauuucuggaguucgaagcccucggauucaugaaugaggaucacugguuuucucgggaaaacagccuguccggcguggagggggagggacuucauaagcugggcuauauucuccgcgacaucucuaaaaucagcgggggaaauauguacgcugaugacaccgccggcugggauacaagaauuaccgaagacgaucugcagaacgaggcgaagaucacagaaauuauggagccugaacacgcccaacuugcuaaagccaucuucaagcugaccuaucagaauaaggucgugcggguucagcgccccgcuaaaaacgggacggugauggacgucauuuccagacgggaucagcgcggcucuggacaagugggcaccuacgggcucaauacauuuaccaacauggaggcccagcugaucagacagauggagagcgaaggaaucuucuccccuagcgagcuggaaacacccaaccucgcggagcgggugcuggacuggcuugaaaaguauggcguugagagacugaaacgcauggccauuucuggggaugacugcguggucaagccgaucgacgaucgguuugcuaccgcccucacggcucugaaugacaugggaaaagugagaaaggauauuccucagugggagcccuccaagggcuggaacgacuggcaacagguuccuuucuguagccaucacuuucaccagcuuaucaugaaagaugggcgcgaaauugugguccccugccggaaucaggacgagcuggugggcagagcccgcgucucucaaggagcuggcuggucccuccgggaaacagccugucugggaaagagcuacgcgcagauguggcagcugauguauuuccauagacgcgaucuccggcuggccgcuaacgccaucugcuccgccgugccuguugacugggugcccaccucuagaacaaccuggagcauucacgcucaucaccaauggaugacgaccgaggauaugcuuuccgucuggaaucgcguguggaucgaagagaacccguggaugaaagacaagacacauaucagcucuugggaggauguuccuuaccugggaaaacgggaagaccagugguguggcucccucauugggcugaccgccagagcgacaugggcuaccaauauccagguggccauuaaccagguccggagacuuaucggaaaugagaacuaccuggacuauaugacaagcaugaagcgcuuuaagaaugaaucugaucccgagggcgcccucugguga

SEQ ID NO: 18454 - RNA, 9879 nt, Artificial Sequence
  derived and/or modified CDS sequence (opt5) from DENV-1__LC128301__SS-prME
agcgugaccaugcugcuuaugcugcuucccacagcccuggcuuuccaccucacgacccggggcggggaaccucauaugaucgucuccaagcaggaacggggaaaaucucugcuuuuuaagacaagcgccggcguuaauaugugcacccugauugcgauggaccucggggagcugugugaagauacaaugaccuacaaaugcccccgcaucacagagaccgaacccgacgauguggacuguuggugcaaugcuacggagaccugggugacauauggaaccuguucccaaacaggcgagcacagacgggauaagcgcucugucgcccuggccccucauguggggcucggacuggaaaccagaacggagacauggaugagcuccgaaggcgcuuggcggcagauucagaaaguugagaccugggcccuucgccaccccggcuucacagugaucgcucuguuucucgcccaugcgauugggaccucuaucacccagaagggaaucauuuucauccugcuuaugcuggucacaccuagcauggccaugagaugcgugggcauugggaaccgggacuuuguugagggacucuccggcgcuacguggguggaugucgugcuggaacacgggagcugugugaccacaauggccaaggacaaacccacccuggauaucgagcuccugaagacagaagucaccaauccugcuguucuucgcaaacugugcauugaggccaagaucucuaacacgacaaccgacuccagauguccgacccaaggagaagcgacacucguggaggagcaggauaccaauuucgugugccggcgcacauuugucgacagaggcuggggcaacggguguggacuguucggcaaagggagccuuauuacgugcgccaaguuuaagugcgugaccaaacuggaaggaaagaucguucaguacgagaaucucaaauauucugugaucgucacagugcacaccggcgaucagcaucaaguugggaacgaaacaaccgagcacggaacgaccgcuacaauuacaccccaagccccuaccuccgaaauccagcugaccgacuacggcgcucugacgcucgacuguagcccccggacaggccuggauuucaaugagauggugcuucugaccaugaaggagaaaucuuggcucguccauaagcagugguuucuggaccuuccucugcccuggacauccggggccagcaccucccaagaaaccuggaaccgccaggaucuccuggugacauucaaaacggcccacgcuaagaagcaggaggucgugguucugggaucucaagaaggcgcgaugcacaccgcccucacaggggcuaccgagauucagacaagcggaaccacgacaaucuuugccggccaucugaaaugcagacuuaagauggacaaacugacccucaaggggguguccuaugucauguguaccggcagcuucaaacuggaaaaggagguggccgagacacagcacggaaccguucuggugcaggucaaguacgaaggcacagaugcuccgugcaaaauuccuuucucuucccaagacgagaagggggugacgcagaauggacggcuuaucaccgccaaccccaucgugacagauaaagaaaagccuguuaauauugaggcggagccgcccuuuggcgaaagcuaucucgucgugggggcuggagagaaagcccugaagcugucuugguucaagaaaggcagcuccaucgggaagauguuugaagccaccgcuagaggcgcccgccggauggcuauucucggagacacagccugggauuucggcucuaucgggggaguguuuaccagcgucggcaaacugauucaucagaucuucgggacggcguacggagugcucuuuuccggcguuagcuggaccaugaagaucgggauuggcauccugcucacauggcugggacugaacucuagauccaccagccuuucuaugacauguauugccgugggcauggucacccucuaccugggggugaugguucaggcugacuccggaugcgugaucaauuggaaaggccgcgagcugaagugugggagcggaauuuucgucacaaacgaagugcacaccuggacggagcaauauaaguuucaggccgauuccccuaaacggcucucugcugccaucggcaaggcgugggaggaagggguuugcggcauuagaagcgccacacgccuggagaacaucauguggaaacagaucuccaaugaacuuaaccauauucugcucgagaaugacaugaaguucaccguggucgugggagacgugaacggcauccuggcucaggggaaaaagaugauucggccgcaacccauggaacacaaauacucuuggaaaagcuggggaaaggccaaagucaucggcgcugauguucagaauaccacauuuauuaucgacgggccuaacacccccgaguguccugaugaccagagagccuggaauaucugggagguggaagauuauggauucggcauuuuuacgacaaacaucuggcugaaacuucgcgacuccuacacccaggugugcgaucaccggcucaugagcgccgcuauuaaagacucuaaggcgguccaugccgauaugggcuauuggaucgaguccgagaagaaugagacauggaagcugaccagagcuagcuucauugaagugaagacauguaucuggcccaaaucucacacccugugguccaacgggguucucgagagcgagaugaucauuccgaagacguacggaggcccuaucucucaacauaauuaucgccccggguacuucacccagacagccggaccuuggcaccugggcaaacuugaacuggacuuugggcucugcgagggaaccacaguggucguggaugaacacugcggcaaccggggccccagccugagaaccacgacaguuaccgggaagauuauccaugagugguguugccgguccuguacacugccuccccuucgcuucaaaggagaggacggcugcugguacgggauggaaauuagaccggugaaggagaaggaagagaaucucguccggagcauggugucugccggauccggcgaaguugauagcuuuucccuggggcugcucuguaucucuaucaugauugaggaggugaugagaagccgcuggucccggaaaaugcugaugaccggaacccuugcugucuuccugcuccugaucaugggccagcugacauggaacgaccuuauuagacugugcaucauggugggcgccaaugcgucugacaagauggggaugggaacgaccuaucucgcucugauggccacauuucgcaugagaccuauguucgccgugggccuccuguuucggcgccuuaccagcagagaaguccugcuccugacaguugggcugucccuuguggcuucuguggagcugcccaacagccucgaagaacugggagauggccucgccauggggauuaugaugcugaaacuucugaccgacuuccaaucccaccagcucugggcggcucugcugagccuuacguuugucaagacaaccuucucucugcauuacgccuggaaaaccauggccaugauccucuccauuaucagccuguuuccccucuguaugucuacaaccucccagaagacaacguggcugccugugcuucugggaagccugggcugcaagccgcucaccauguuccugaucacagaaaacaaaauuuggggccggaagucuuggccccuuaaugaggggaucauggcuguuggaauuguguccauccugcucagcucccugcucaaaaacgaugucccucuggccggcccccuuauugcugggggaaugcugaucgccuguuaugugaucagcggcucuagcgcggaccugucccucgagaaggccgcugaaguuucuugggaggaagaggccgaacacagcggggcuucccauaauauucugguggagguccaggaugacggaaccaugaaaaucaaggaugaggaacgcgacgauacacuuaccauucugcucaaagccacgcugcucgccaucucuggcguguacccuaugagcauucccgcuacccuguuugucugguauuucuggcaaaagaagaaacagagauccggcgugcuuugggacacaccuucucccccggagguugaacgggcggugcuggaugacgggaucuaccgcauccugcagagaggacuccugggcaagagccaggucggggugggaguuuuccaagagggcguguuucacaccauguggcacgucacaagaggggccgugcuuauguaucagggaaaacgccuggagccuuccugggcuagcgugaagaaagaucucauuucuuacggcggcggguggagauuccagggauccuggaacaccggcgaagagguucaggucaucgccguggaacccgggaagaauccuaagaacgugcaaacagcccccggaacguuuaaaaccccggagggcgaagucggggcuauugcccuggacuucaagccuggaacaagcggcucucccaucgugaaucgggagggcaaaauuguugggcucuacggaaacggcguggucaccaccuccgggacauaugugagcgcgaucgcucaggccaaggccucccaggagggaccucugcccgaaauugaggacgaaguuuuuagaaaacgcaaucuuacgaucauggaucugcaucccggcucugggaagacccggagauaccugccugcuaucgugcgcgaggccauuaagcggaaacucagaacacugguccuugcgccgacccgcgugguugcuagcgaaauggccgaggcccugaagggcaugcccauccgguaucaaacaaccgcugugaaauccgagcacacgggaaaggaaauugucgaccucaugugccaugccacauucaccaugagacugcugagcccugugcgcgugcccaacuacaauaugaucauuauggaugaggcucacuuuaccgacccugccucuaucgcggcccggggcuauaucuccacaagagucgggaugggagaagcugccgcuauuuucaugaccgccacacccccuggcagcauggaggccuuuccgcagucuaacgcugcgauccaggaugaagaacgggacauucccgagcgcagcuggaacuccggguacgauuggaucaccgacuucccuggaaaaacgguuugguuugugcccucuauuaagagcggcaacgauaucgccaauugucucagaaagaacgggaaacgggugguccagcuuucccgcaagacauucgacaccgaauaucagaagaccaagaacaaugauugggacuacgugguuaccacggacaucucugagaugggcgcuaacuucagagccgaucgggugauugacccuagacgcugccugaaacccgucauccugaaggauggaccggaacgggugauucucgccggcccuaugcccguuaccguggcuagcgccgcgcagagacgcgggcggaucggaagaaaucagaacaaggagggcgaccaguacauuuauauggggcaaccccugaauaacgaugaggaccaugcucacuggacagaagccaaaaugcuucuggauaauaucaacaccccugagggaauuauccccgcccucuuugaaccugagcgcgaaaaguccgcugccaucgacggcgaguaccggcugagaggggaggcgcgcaaaacauucgucgaacugaugagacggggcgaucucccgguguggcuuagcuauaaggucgccucugagggauuucaguacuccgaccgcagauggugcuucgauggcgaacggaauaaccaggugcuggaggaaaauauggacguugagauuuggaccaaagagggggaacgcaagaaacugagaccccgguggcucgaugcuagaacauauagcgacccucuggcccuucgcgaguuuaaggaguucgcugccggacggagauccgugucuggcgaccugauccucgagauugggaagcugccccagcaccugacccaacgcgcucagaacgcccucgauaaucuugugaugcugcauaacagcgaacagggaggcaaagcguaccggcacgccauggaggagcugccugacacgaucgaaacacucaugcugcuugcucugauugccguccucaccggcgggguuacccuguuuuuccuguccggaagaggccucgggaagacaucuaucggacuucugugugugauggcuagcuccgcccugcucuggauggccagcguggagccccauuggaucgcugcgucuauuauccuggaauuuuuccuuaugguccugcucauuccggagccugaucggcagcgcacaccccaagacaaucagcuggccuaugugguuaucggccugcucuuuaugauucuuacaguggcugccaacgagauggggcugcuggaaacgaccaaaaaggaucucggaaucggccacgucgccgcugagucccaccaucacgccgcgaugcuggacguggaucuucauccugccagcgcuuggacacuguacgccgucgcuaccacaaucauuacccccaugaugagacacacgaucgaaaacaccacagccaauauuucucucaccgcgaucgccaaccaggcugccauucugaugggccuggacaaaggguggccuaucuccaagauggauauuggagugccccuccuugcucugggcugcuacagccaaguuaauccgcugacacucaccgccgcugugcugaugcuugucgcccauuaugcgaucaucgggccuggacugcaggccaaggcuacgcgggaggcccagaaacgcacagcugccggcauuaugaagaaccccaccguggacgggaucguugccauugaucucgaccccguggucuacgaugcgaaauucgaaaagcagcugggacaaaucaugcugcucauucuuuguacaucucagauccugcugaugagaaccaccugggcucucugcgagagcaucacacuggccacgggcccucuuaccacacugugggagggcuccccggggaaauuuuggaauaccacaauugcugugucuauggccaacaucuuccggggaagcuaucucgccggcgcugggcuggccuucucccugaugaaaagccucggaggcgggcgcagaggaaccggcgcgcagggcgaaacgcuuggggagaaguggaaacggcagcugaaucaacuguccaagucugaauuuaacacauacaaacgcagcggaauuauggagguggacagauccgaagccaaggagggccucaaaagaggggaaaccaccaagcacgcuguuucucggggaacagccaagcugcgcugguucgucgaacggaaucuugugaaacccgagggcaaggugaucgaccugggguguggaagaggcggcuggagcuauuacugcgcugggcucaaaaaggucaccgaaguuaaaggauauacaaagggcgggccuggacacgaggaacccauuccuauggccacguacggcuggaaccuggugaaacuguacuccgggaaggauguguuuuucacacccccugagaagugugacacccuccuuugcgauaucggagagucuagcccgaaucccaccaucgaagagggccgcacacugcggguccugaaaaugguggaaccuuggcucagaggcaaccaguuuuguauuaagguucugaaucccuauaugccuuccguggucgagacccuugagcagaugcagcgcaaacaugggggaaugcuggugcggaacccccucagcagaaauucuacgcacgaaauguacuggguuuccugcggcaccgggaacaucgugagcgcggucaauaugacaucucgcaugcugcugaaccgguucaccaugacacauagaaagccgaccuaugagaaagacguggaucucggagccggcacacgccacguggcugucgaaccugagguugccaaccuggacauuaucgggcaacggauugaaaauaucaagaacgagcacaaguccaccuggcauuacgaugaggacaaucccuauaaaacgugggcuuaccacggaagcuaugaagugaagcccucuggcuccgccagcuccauggugaacggcgucgugagacuucugacaaaaccuugggauguuauucccauggugacccagaucgcuaugaccgacacaacgccuuuugggcagcaacgcgucuucaaggagaaaguggauaccagaacaccgaaggccaagcggggaaccgcgcagaucauggaaguuacagcccgcuggcucuggggcuuucugagcagaaauaaaaagccccggauuuguaccagagaggaguucacacggaaagugcgcucuaacgcugccaucggggcugucuuuguggacgagaaucaguggaacagcgccaaggaggccguugaagacgagagauucugggaucuugugcaucgggaacgcgagcugcacaaacagggaaagugcgcgaccugcgucuacaauaugaugggcaagagagagaagaagcucggggaguuuggcaaagcuaagggaucccgggccauuugguacauguggcugggcgcccgcuuccuggaguucgaagcucucggguuuaugaacgaggaccauugguucucuagagaaaauagccuguccggaguggagggcgaggggcuucacaaacugggauauauccuccgggauauuucuaagaucccuggcgggaacauguacgccgacgauacggcuggcugggacacccgcaucacagaagaugaccugcaaaaugaggccaaaauuaccgauaucauggaacccgagcacgcgcuucuggccacaagcauuuuuaagcucaccuaucagaacaaggucgugagaguucagcggccugcuaaaaauggaacggugauggacgucaucucccgcagagaucagcggggcucugggcaagugggaacauacggccugaacaccuucacaaacauggaagcccagcugauucgccagauggagagcgaggggaucuuucuccccuccgaacuggagaccccgaaucuugcugaaagagugcuggacuggcucgagaagcauggaacggaacggcugaaaagaauggccaucagcggcgaugacuguguugugaagccuauugacgaucgcuucgcgaccgcccuuacagcucugaacgacauggggaaaguccggaaggauaucccccagugggagccuucuaagggcuggaaugacuggcaacaggugcccuuuugcucccaccauuuccaccagcucauuaugaaagauggaagagagaucguugugccuugucgcaaccaggacgaacuggucggccgggccagagugagccaaggggcuggauggucucugcgcgagaccgccugccucggcaaguccuaugcucagauguggcagcugauguacuuucaccggagagaucuucgccuggccgcgaaugccauuuguagcgcuguccccguggacuggguuccgacaucccggaccacauggucuauccaugcccaccaucaauggaugaccacggaagauaugcucagcguguggaacagagucuggaucgaggaaaauccuuggauggaggacaaaacacacguguccagcugggaggauguucccuaucuggggaagcgcgaagaccaguggugcggaucucuuauuggccugaccgcccgggcuaccugggccacaaacauccagguggcgauuaaucaggucagacggcucaucgggaacgagaauuaccuggacuacaugaccuccaugaaaagauucaagaacgaaagcgaucccgagggcgcucugugguga

SEQ ID NO: 18455 - RNA, 9879 nt, Artificial Sequence
  derived and/or modified CDS sequence (opt5) from DENV-1__LC011945__SS-prME
agcgugaccaugcugcucaugcugaugcccacagcccuugcuuuccaccugacgaccagaggaggggaaccucauaugaucgucuccaagcaggaacggggaaaaucucuccuguuuaagaccagcgccggcguuaacaugugcacccuuauugcgauggaccugggggagcucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaaguucacaguuguggucggagauguggcuggcauucucgcccaggggaaaaagaugauccggccgcaacccauggagcacaaauacucuuggaaaagcuggggaaaggccaaaauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaagcugcgcgauuccuacacacagguuugcgaccaccggcuuaugagcgccgcuauuaaagauucuaaggccgugcaugccgacaugggcuauuggaucgaauccgagaaaaaugaaaccuggaagcucgcuagagccagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgcgggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuacagaggggaggacggaugcugguauggcauggagauucggccggugaaagaaaaggaggaaaaucuuguuaagagcauggugucugcuggguccggagaggucgacagcuucucccucggccugcuguguaucucuauuaugaucgaagaggugaugagaagccgcuggucccggaaaaugcucaugacagggacccuggccgucuuuuuccuucugauuaugggacagcucacauggaacgaucugaucagacugugcauuauggugggcgccaaugcuucugaccgcaugggcauggggaccaccuaccuugcccugauggcgacauuuaagaugagaccuauguucgcugucggacuccuguuucggcgccucacgagcagagaggugcugcuucugaccaucggccucucccugguggccucugucgaacugcccaacagccuugaggaacugggggauggacucgccaugggcaucaugauucugaaacuccugacagacuuccaaucccaccagcuuugggcuacccugcucagccugacauuuaucaagaccacguucucucugcauuaugccuggaaaacaauugcuaugguucuuuccaucgugagccuguuuccccucugucugucuaccaccucccagaagacaaccuggcucccugugcugcuugggagccugggaugcaagccgcugacaauguuccucauugccgagaauaaaaucuggggccggaagucuuggccccugaacgaaggcaucauggcggucgggauuguguccauccuucugagcucccuccugaaaaacgauguuccucucgccggaccccugauugcuggcgggaugcuuaucgccuguuacgugauuagcggaucuagcgcugaccugucccuggagaaggccgccgaggucucuugggaagaggaagcugagcacagcggcgcgucccauaauauccucguggaaguucaggaugacgggacgaugaaaaucaaggaugaggagcgcgacgauacccugacaauucuucugaaagccacccuccuggcugugucuggagucuauccucucagcauccccgccacacuguuugugugguacuucuggcaaaagaagaaacagagauccggcguccuuugggacaccccuucucccccggaaguggagcgggccguucuggaugacggcauuuaucgcaucaugcagagagggcugcucggacggagccaggugggcgucgggguguuccaagaaaacguuuuucacacgauguggcacgugacccgcggagcuguccugauguaccagggcaagagacuugagccuuccugggccagcgugaaaaaggaccugauuucuuacgggggaggcuggcggcuccagggcuccuggaauacaggggaggaagugcagguuaucgcggucgagcccggcaaaaauccuaagaaugugcaaaccgcucccggcacauucaagaccccggaaggggaggugggagccauugcccuggauuuuaaaccuggcacaagcgggucucccaucgucaacagagaaggaaagaucgugggccucuauggcaaugggguugugacgaccuccggaacauacgucagcgcuauugcccaggcgaaggcuucccaggagggcccucugcccgagaucgaagacgagguguuccgcaagcggaaccuuaccauuauggaucugcaucccgggucuggaaaaaccagacgcuaucugccugccaucguucgggaagccauuaagagaaagcuccgcacacugauccuugcuccgacgcggguggucgccagcgagauggcugaagcccugaaaggcaugcccaucagauaccaaaccacagcggugaaguccgagcacaccgggaaagagauuguugaccucaugugccaugccacauuuaccaugcgccugcugagcccugugcggguccccaauuauaacaugaucauuauggaugaagcucacuucacggacccuucuuccaucgccgcuagaggcuacauuagcacacgggugggaaugggcgaggccgccgcuaucuuuaugaccgcgacacccccugggucuguggaagccuucccgcagagcaaugcugucauccaggaugaggaacgcgacauucccgagagauccuggaacucuggauaugaguggaucacagauuuuccuggcaagaccguuugguucgugcccagcauuaaauccgggaaugacaucgccaacugucuccggaagaauggaaagcgcgugauucagcuuucuagaaaaacauuugauaccgaauaccaaaagacgaaaaacaacgacugggacuacgucgugacaaccgauaucagcgagaugggcgccaauuuccgggcugacagaguuauugauccucgccggugccugaagcccgugauccugaaagacggguccgaaagagucauccucgccggcccgaugccugugacaguugcgagcgcugcccagcgccggggaagaauuggccgcaaccauaauaaggagggggaucaguauaucuacaugggacagccccugaacaaugacgaggaucacgcccacuggaccgaagcuaagaugcuucuggacaacauuaauacgcccgagggcaucauuccugcccucuucgaacccgagcgggaaaaaucugcggccaucgauggggaguauagacugcgcggagaggcuagaaagaccuuuguggaacugaugcggcgcggcgaccucccugucuggcuuuccuacaaaguggccagcgagggguuccaauauuccgauagacgguggugcuuugacggcgaacgcaacaaucagguccuggaggaaaacauggauguggagaucuggacaaaggagggagaacgcaagaaacugcggccgagauggcucgacgcucgcaccuacucugacccccuggcccuucgggaguucaaagaauuugcugccggcagacgcagcguuuccggggaucugauucucgagaucggaaagcugccucagcaucugacacagcgggcgcaaaaugcccucgacaaccuugugaugcugcacaauucugaacagggcgggagagcuuaucggcaugccauggaggagcugcccgauaccauugaaacacucaugcugcuugcucugaucgccgugcucaccggaggcgucacgcuguucuuucugagcggcaaggggcucggaaaaacauccauuggccuucuguguguuauggccagcucugugcugcucuggauggcuuccguggagccucacuggaucgcggccagcaucauucuggaguucuuucuuaugguccugcucauccccgagccggaccgccagagaaccccucaggauaaccaacuggcuuacgugguuauugggcuccuguucaugauccuuaccguggccgccaaugagaugggacugcuggaaacaaccaagaaagaccucggcauugggcacgucgcuguggagaaccaucaccaugccgcgaugcuggaugucgaccuucaccccgccucugcuuggacacuguacgccguggcuacgaccaucauuacaccuaugaugcggcauaccaucgaaaacacaaccgccaauaucucccucacggcgauugccaaccaggcugccauccugaugggacuggauaagggcuggcccauuagcaaaauggacaucggcguuccucuccuugcucuggggugcuauucucaggugaauccccugacccucacagccgcuguccugaugcuuguggcccacuacgcgauuaucggaccgggccugcaagccaaggcuacccgcgaggcccagaagagaacagcugccgggaucaugaaaaacccuaccguugauggaauuguggccaucgaccucgaucccgucguguaugacgcgaaguuugaaaaacagcugggccagauuaugcugcucauccuuuguacgagccaaauucugcugaugcggacaaccugggcucucugcgaguccaucacacuggccaccgggccccuuaccacacugugggagggaucuccuggcaaguucuggaauacgaccaucgcugugagcauggccaacauuuuucgcggcuccuaccucgccggggcuggacuggccuucagccugaugaaaucccucggcgggggaagacggggcacaggggcgcagggagaaacccuuggcgagaaguggaagcgccagcugaaucagcugucuaaaagcgaguucaacacauauaagagauccggcaucauggagguugaccggucugaagccaaagaggggcucaagagaggagagaccacgaaacacgcugucagccgcggcacagccaagcugcggugguuuguggaaagaaaucuugugaagccggaggggaaagucauugaucugggauguggccgcgggggaugguccuacuauugcgcuggccucaagaaaguuaccgaagugaagggcuacaccaaagggggacccggccaugaggaaccugugcccauggccacauacggguggaaccuggucaagcugcacucuggaaaagacguguucuuuaucccucccgagaagugugauacccuccuuugcgacauuggcgagagcuccccuaauccgacaaucgaagaggggcggacgcugagaguucugaagaugguggaacccuggcuccgcggaaaccaauucuguauuaaaauccugaauccuuauaugcccagcgucguggagacccuugagcagaugcagcggaagcauggcggcaugcugguuagaaacccucucucucgcaauuccacacacgaaauguacugggugagcugcgggaccggaaacaucgucucugcgauuaauaugacaucccggaugcugcugaacagauuuaccauggcccaccgcaaacccacguaugagcgggauguggaccucggcgcugggaccagacauguggccgucgaaccggagguugcuaaccuggauaucauuggacagcgcaucgaaaauauuaagugugagcacaaaagcacauggcauuacgacgaggauaacccuuauaagaccugggccuaccacggcucuuaugaagugaagcccuccgggagcgcuuccagcauggugaauggagucgugaaacuucugacaaagcccugggacguuaucccuauggugacccaaaucgccaugacagauaccacgcccuucggccagcagagagucuuuaaagagaagguggacacacggaccccuaaagcgaagcgcggcaccgcccaaauuauggaaguuacagcuagauggcucuggggguuccugucucggaacaagaaaccgagaaucugcacgcgggaggaauuuacccgcaaggugagaagcaaugccgcuauuggagccgucuucguggacgagaaccaguggaacuccgccaaagaggcgguugaagaugagcgguuuugggaccuugugcaucgcgaaagagagcugcacaagcagggcaaaugcgcuacaugugucuacaacaugauggggaagcgggaaaagaaacucggagaguucggcaaggccaaagggucucgcgccaucugguacauguggcugggcgcuagauuucuggaguucgaagcccucggauucaugaaugaggaucacugguuuagccgggaaaacucccugucuggcguggagggggagggacuucauaagcugggcuauauucuccgcgacaucagcaaaaucuccgggggaaauauguacgcugaugacaccgccggcugggauacaagaauuaccgaagacgaucugcagaacgaggcgaagaucacagaaauuauggagcccgaacacgcccaacuugcuaaagccaucuucaagcugaccuaucagaauaaggucgugcggguucagcgcccugcuaaaaacgggacggugauggacgucauuucuagacgggaucagcgcggcagcggacaagugggcaccuacgggcucaauacauuuaccaacauggaggcccagcugaucagacagauggaguccgaaggaaucuucagccccucugagcuggaaacaccuaaccucgcggagcgggugcuggacuggcuugaaaaguauggcguugagagacugaaacgcauggccauuuccggggaugacugcguggucaagcccaucgacgaucgguuugcuaccgcccucacggcucugaaugacaugggaaaagugagaaaggauauuccgcagugggagccuagcaagggcuggaacgacuggcaacagguucccuucuguucucaucacuuucaccagcuuaucaugaaagaugggcgcgaaauuguggucccuugccggaaucaggacgagcuggugggcagagcccgcgucucccaaggagcuggcuggagccuccgggaaacagccugucuggggaaguccuacgcgcagauguggcagcugauguauuuccauagacgcgaucuccggcuggccgcuaacgccaucugcucugccgugcccguugacugggugccuaccagcagaacaaccugguccauucacgcucaucaccaauggaugacgaccgaggauaugcuuagcgucuggaaucgcguguggaucgaagagaaccccuggaugaaagacaagacacauaucucuuccugggaggauguuccguaccugggaaaacgggaagaccagugguguggcagccucauugggcugaccgccagagcgacaugggcuaccaauauccagguggccauuaaccagguccggagacuuaucggaaaugagaacuaccuggacuauaugacaucuaugaagcgcuuuaagaaugaaagcgauccugagggcgcccucugguga

SEQ ID NO: 18456 - RNA, 9879 nt, Artificial Sequence
  derived and/or modified CDS sequence (opt5) from DENV-1__LC011949__SS-prME
agcgugaccaugcugcucaugcugguccccacagcccuugcuuuccaccugacgaccagaggaggggaaccucauaugaucguuuccaagcaggaacgggggaaaucucuccuguuuaagaccagcgccggcgugaacaugugcacccuuauugcgauggaccugggggagcucugugaagauacaaugaccuacaaaugcccgcgcaucacagaggcugaacccgacgauguggacuguuggugcaaugccaccgauacgugggucaccuauggaacauguucccaaaccggcgagcacagacgggacaagcgcucuguggcccuggcuccucauguugggcugggacucgagacaagaaccgaaacguggaugagcuccgagggcgccuggaaacagauucagcggguggaaacaugggcucugcgccaccccggcuucaccgucaucgcccuuuuucuggcgcaugccauugggacaucuaucacccagaagggaaucauuuucauccuccugaugcuugugaccccuagcauggcuaugagaugcguuggcauugggucccgggauuuuguggagggacugagcggcgccacaugggucgacguggugcucgagcacgggucuugugucacgaccauggcuaaggauaaacccacacuggacaucgaacugcucaagaccgagguuacaaacccugccgugcugcgcaaacuuugcauugaagcgaagaucuccaauaccacgacagauagcagauguccgacccaaggagaggccacccugguggaagaacaagacgcuaacuucgucugccggcgcacauuuguggauagaggcuggggcaauggguguggacucuucggcaaagggucucugauuaccugcgccaaguuuaagugcguuacaaaacuugagggaaagaucgugcaguacgaaaaccugaaauauuccgucaucgugacgguucacaccggcgaccagcaucaaguggggaaugagagcacagaacacggaaccacagcuaccauuacgccccaggccccuaccacagagauccagcucaccgacuacggcgcccugacacuggauuguucuccccggaccggccucgacuucaacgaaaugguccugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaagugguugugcugggaagccaagagggcgcuaugcacacagcccugacgggggccaccgaaauucagacauccggaaccacaaccaucuuugcuggccaucucaaaugcagacugaagauggauaaacuuacgcugaaggggacaagcuaugucauguguaccggcucuuucaaacucgagaaggaaguggccgagacccagcacggaacaguucuggugcagauuaaguacgagggcaccgacgcgccgugcaaaaucccuuucuccacacaagaugaaaagggggucacgcagaacggacggcugaucaccgcuaaucccauugugacagacaaagagaagccugugaacaucgaagccgagccgcccuuuggcgagagcuauauuguuaucggggccggagaaaaagcucuuaagcucucuugguucaagaaaggcagcuccauugggaagauguuugaggccaccgcuagaggcgcccgccggauggcgauccugggagauacagccugggacuucggcucuaucgggggagucuuuaccagcgugggcaaacuggugcaucagauuuucgggacggcuuacggaguccucuuuuccggcgugagcuggaccaugaagaucgggauuggcguucugcuuacauggcugggacucaauucuagauccaccagccugucuaugacauguaucgccgugggccuggucacccuuuaccucggggugaugguucaggcugauacaggaugcgugauuaacuggaaaggccgcgaacugaaguguggguccggaaucuucgucaccaaugaggugcacacguggacagaacaauauaaguuucaggccgacagcccuaaacggcuguccgcggccauuggcaaggcuugggaggaggggguuugcggcaucagaucugccacccgccucgaaaacaucauguggaaacagauuagcaacgagcugaaucauauccuucuggaaaacgacaugaaguucaccguggucgugggagauguggcuggcauucucgcccaggggaaaaagaugauccggccgcaacccauggaguacaaauauuccuggaagucuuggggaaaggccaaaauuaucggcgcugacguccagaauacaaccuuuaucauugaugggccuaacacgcccgaauguccugacgaucagagagcguggaauaucugggagguugaggacuacggauucggcauuuuuacaaccaacaucuggcugaagcugcgcgauagcuauacacaggugugcgaccaccggcuuauguccgccgcuauuaaagauagcaaggccgugcacgccgacaugggcuacuggaucgaaucugagaaaaaugaaaccuggaagcucgcuagagccuccuucaucgaggucaagacauguauuuggcccaaaagccauacccuguggucuaacggggugcuggaauccgagaugaucauuccgaagaucuauggaggcccuauuagccaacacaauuaccgccccggguacuucacgcagaccgcgggaccuuggcaucucggcaaacuggagcuugauuuugaccugugcgaagggacaaccguuguggucgaugagcacugcggaaaccggggccccucucucagaacaaccacggugacaggcaagaucauccacgaaugguguugccggagcuguacccugccuccccugcgcuucagaggggaggacggaugcugguauggcauggagauucggccgguuaaagaaaaggaggaaaaucuugugaaguccauggucagcgcugggucuggagagguggacuccuuuagccucggccugcuguguaucuccauuaugaucgaagagguuaugagaucucgcuggagccggaaaaugcucaugacagggacccuggccguguucuuucuucugauuaugggacagcucaccuggaacgaucugaucagacugugcauuauggucggcgccaaugcuuccgaccgcaugggcauggggacaacguaccuugcccugauggcgaccuucaagaugagaccuauguuugcugugggacuccuguuccggcgccucacaucuagagaggugcugcuucugaccaucggccucagccuggucgccuccguugaacugcccaacucucuugaggaacugggggauggacucgccaugggcaucaugauucugaaacuccugacagacuuucaaagccaucagcuuugggcuacccugcucucccugacguucaucaagacaaccuuuagccugcacuaugccuggaaaaccauggcuauggugcuuucuauugugucccuguucccccucugucugagcacaaccucucagaagacaacguggcucccuguccugcuugggucccugggaugcaagccgcugaccauguuucucaucgccgagaauaaaauuuggggccggaaguccuggccccugaacgaaggcaucauggcgguggggaucguuucuauucuucuguccagccuccugaaaaacgaugugccucucgccggaccccugaucgcuggcgggaugcuuauugccuguuacgucaucuccggaagcucugcugaccugagccuggagaaggccgccgagguguccugggaagaggaagcugagcauucuggcgcgagccacaauauucucguugaagugcaggaugacgggacaaugaaaaucaaggaugaggagcgcgacgauacccugacaauccuucugaaagccacccuccuggcugucuccggaguguauccucucucuauucccgccacgcuguucgucugguacuucuggcaaaagaagaaacagagaagcggcgugcuuugggacaccccuagcccucccgaaguugagcgggccgugcuggaugacggcaucuaucgcauuaugcagagagggcugcucggacggucucaggucggcguggggguuuuucaagaaaacguguuccauacaauguggcacgucacccgcggagcugugcugauguaccagggcaagagacuugagcccagcugggccuccgugaaaaaggaccugaucagcuacgggggaggcuggcggcuccagggcucuuggaauacaggggaggaaguucaggucauugcgguggagcccggcaaaaauccuaagaaugugcaaaccgcucccggcacauuuaagacgccggaaggggaggucggagccaucgcccuggauuucaaaccuggcaccuccgggagccccauugugaacagagaaggaaagaucguuggccucuauggcaaugggguggucacaaccucuggaaccuacguguccgcuaucgcccaggcgaaagcuagccaggagggcccucugcccgagauugaagacgagguuuuuaagaaacgcaaccuuacaaucauggaucugcaccccggguccggaaagacgcggagauaucugccugccauugugcgcgaagccaucaagcggaaacucagaacccugauucuugcuccgacacgcgucguggccucugagauggcugaagcccugaagggcaugcccauccgguaccaaaccacagcgguuaaaagcgagcauaccgggaaggagaucguggaccucaugugccacgccacguucacaaugagacugcuguccccuguccgcgugcccaauuauaacaugauuaucauggaugaagcucauuuuaccgacccuagcucuauugccgcucggggcuacaucuccaccagagugggaaugggcgaggccgccgcuauuuucaugacagcgacacccccugggagcgucgaagccuuuccgcagucuaaugcuguuauccaggaugaggaacgggacauccccgagcgcagcuggaacuccggauaugaguggauuacagauuucccuggcaaaaccgugugguuugugcccucuaucaagagcgggaaugacauugccaacugucucagaaagaauggaaaacgggucauccagcuuucccgcaagacguucgauacagaauaccagaaaaccaagaacaacgacugggacuacgugguuacaaccgauauuucugagaugggcgccaauuucagagcugaccgggugaucgauccuagacgcugccugaaacccgucauucugaaggacgggccggaacgggugauccucgccggcccuaugcccguuacgguggcgagcgcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacaccugagggcauuauccccgcccucuuugaaccugagcgcgaaaaguccgcggccauugauggggaguaucggcugagaggagaggcucgcaaaaccuucgucgaacugaugagacggggcgaccucccgguguggcuuagcuacaaggucgccucugagggguuucaauauuccgaucgcagauggugcuucgacggcgaacggaacaaucaggugcuggaggaaaacauggauguugagaucuggacaaaagagggagaacgcaagaaacugagaccccgguggcucgacgcuagaaccuacagcgacccucuggcccuucgcgaguuuaaggaguucgcugccggccggagauccaucucuggggaucugauucucgagaucggaaagcugccccagcaccugacacagcgcgcgcaaaaugcccucgacaaccuugugaugcugcauaauagcgaacagggcgggcgggcuuauagacacgccauggaggagcugccugauaccauugaaacgcucaugcugcuugcucugaucgccgugcucacaggaggcgucacccuguuuuuccuguccggccgggggcucggaaaaaccucuauuggccuucuguguguuauggccagcuccgugcugcucuggauggcuagcguggagccccauuggaucgcggccucuaucauucuggaauuuuuccuuaugguccugcucaucccggagccugaccgccagagaacaccccaggauaaccaacuggcuuacgugguuauugggcugcucuuuaugauccuuaccguggccgccaaugagaugggacugcuggaaacaacgaagaaagaccucggcauugggcacgucgcuguggagaaccaccaucacgccgcgaugcuggaugucgaccuucauccugccuccgcuuggacccuguacgccguggcuacaaccaucauuacacccaugaugcggcacaccaucgaaaacacgaccgccaauaucagccucacagcgauugccaaccaggcugccauccugaugggacuggauaagggcuggccuauuucuaaaauggacaucggcguuccccuccuugcucuggggugcuauucccaggugaauccgcugacccucacagccgcuguccugaugcuuguggcccauuacgcgauuaucggaccuggccugcaagccaaggcuacccgcgaggcccagaagagaacggcugccgggaucaugaaaaaccccacaguugauggaauuguggccaucgaccucgaucccgucguguaugacgcgaaguucgaaaaacagcugggccagauuaugcugcucauccuuuguaccagccaaauucugcugaugcggacaaccugggcucucugcgagucuaucacccuggccacagggccucuuacgacccugugggagggaagcccgggcaaguuuuggaauacaaccaucgcuguguccauggccaacauuuuccgcggcucuuaccucgccggggcuggacuggccuucagccugaugaaaucccucggcgggggaagacggggcacaggggcgcagggagaaacccuuggcgagaaguggaagcgccagcugaaucagcugagcaaauccgaauuuaacacguauaagagaucuggcaucauggagguugaccggagcgaagccaaagaggggcucaagagaggagagacaaccaaacacgcugucucccgcggcaccgccaagcugcggugguucguggaaagaaaucuugugaagcccgaggggaaagucauugaucugggauguggccgcgggggauggucuuacuauugcgcuggccucaagaaaguuacagaagugaagggcuacaccaaagggggaccuggccacgaggaacccaucccuauggccacauacggguggaaccuggugaagcugcauagcggaaaagacgucuuuuucauucccccugagaagugugauacgcuccuuugcgacaucggcgaguccucuccgaaucccaccauugaagaggggcggacacugagagugcugaagaugguugaaccuuggcuccgcggaaaccaauuuuguaucaaaauccugaaucccuauaugccuagcguggucgagacccuugagcagaugcagcggaagcacggcggcaugcuggugagaaacccccucucccgcaauagcacacaugaaauguacuggguuucuugcgggaccggaaacauuguguccgcggucaauaugacgagccggaugcugcugaacagauucaccauggcccaccgcaaaccgacauaugagcgggauguggaccucggcgcugggaccagacacguggccgucgaaccugagguugcuaaccuggauaucauuggacagcgcaucgaaaauauuaagcaugagcacaaaucuacauggcauuacgacgaggauaaccccuauaagaccugggccuaccacggcuccuaugaagugaagcccagcgggucugcuuccagcauggugaauggagucgugaaacuucugacaaagccuugggacguuauccccauggugacccaaaucgccaugacggauacaaccccuuuuggccagcagagagucuucaaagagaagguggacacccggacaccgaaagcgaagcgcggcacggcccaaauuauggaaguuaccgcuagauggcucuggggguuucugucccggaacaagaaacccagaaucuguacacgggaggaguucacccgcaaggugagaagcaaugccgcuauuggagccgucuuuguggacgagaaccaguggaacucugccaaagaggcgguugaagaugagcgguucugggaccuugugcaucgcgaaagagagcugcacaagcagggcaaaugcgcuacaugcgucuacaacaugauggggaagcgggaaaagaaacucggagaguuuggcaaggccaaagggagccgcgccaucugguacauguggcugggcgcuagauuccuggaguucgaagcccucggauuuaugaaugaggaucacugguucucccgggaaaacucucugagcggcguggagggggagggacuucauaagcugggcuauauucuccgcgacaucuccaaaaucccugggggaaauauguacgcugaugacaccgccggcugggauacaagaauuaccgaagacgaucugcagaacgaggcgaagaucacggacauuauggaacccgagcacgcccuucuggcuaaagccaucuuuaagcucaccuaucaaaauaaggucgugcggguucagcgcccugcuaaaaacgggacagugauggaugucauuucuagacgggaccagcgcggcagcggacaggugggcaccuacgggcugaauacauucaccaacauggaagcccaacugaucagacagauggaguccgagggaaucuuucuccccucugaacuggagacgccgaaccuugcggaacgggugcuggauuggcucgagaaguauggcguugaaagacugaaacgcauggccauuagcggggacgacuguguggucaagccuaucgaugaccgguucgcuacagcccuuaccgcucugaaugauaugggaaaagugagaaaggacauuccccagugggagccuuccaagggcuggaacgauuggcagcaaguucccuuuugcagccaucacuuccaccagcucaucaugaaagacgggcgcgagauuguggucccuugucggaaucaggaugaacuggugggcagagcccgcgucucucagggagcuggcuggucccugcgggagacagccugccucggaaagagcuacgcgcaaauguggcagcugauguauuuucauagacgcgaccuucggcuggccgcuaacgccaucuguucugccgugcccguugauugggugccgaccuccagaacgaccuggagcauucacgcucaucaccaguggaugacaaccgaagacaugcucuccgucuggaaucgcguguggaucgaggaaaacccuuggauggaggauaaaacacauaucucuagcugggaggacguucccuaccugggaaagcgggaagaccaauggugcggcucccuuauugggcugaccgccagagcgacaugggcuaccaauauccagguggccauuaaccagguccggagacucaucggaaaugagaacuaccuggauuauaugacgagcaugaaacgcuucaagaaugaaucugaccccgagggcgcccugugguga

SEQ ID NO: 18457 - RNA, 9879 nt, Artificial Sequence
  derived and/or modified CDS sequence (opt5) from DENV-1__HM469966__SS-prME
agcgugaccaugcugcucaugcugaugcccaccgcccuugcuuuccaccugacgacccggggaggggagccucauaugaucgucuccaagcaggaacggggaaaaucucuccuguuuaagaccagcgccggcguuaacaugugcacccuuaucgcgauggaccugggggagcucugugaagauacaaugaccuacaaaugccccagaaucacagaggcugaacccgacgauguggacuguuggugcaaugccaccgauacgugggugaccuauggaacauguucccaaaccggcgagcaccggcgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugaugaccugcgccaaguuuaagugcgugacaaaacuugagggaaagauuguucaguacgaaaaccugaaauauuccgugaucgucacggugcacaccggcgaccagcaucaaguugggaaugagagcacagaacacggaaccacagcuaccaucacgccccaggccccuaccacagagauucagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauccagacauccggaaccacaaccauuuuugcuggccaucucaaaugcagacugaagauggauaaacuuacgcugaaggggaugagcuaugugauguguacaggcucuuucaaacucgagaaggaagucgccgagacccagcacggaaccgugcugguucagaucaaguacgagggcacagacgcgccgugcaaaauuccuuucuccacccaagaugaaaagggggugacacagaacggacggcugaucacggcuaaucccaucgucaccgacaaagagaagccugugaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauucugggagauaccgccugggacuucggcucuaucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggcuggcauccucgcccaggggaaaaagaugauucggccgcaacccauggaguacaaauauucuuggaaaagcuggggaaaggccaaaaucauuggcgcugacgugcagaauaccaccuuuaucaucgaugggccuaacacacccgaauguccugacgaucagagagcguggaauauuugggaggucgaggacuacggauucggcaucuuuaccacgaacauuuggcugaagcugcgcgauuccuauacacagguuugcgaccaccggcuuaugagcgccgcuaucaaagauucuaaggccgugcacgccgacaugggcuacuggauugaauccgagaaaaaugaaaccuggaagcucgcuagagccagcuucaucgaggugaagacauguaucuggcccaaaucucauacccugugguccaacgggguccuggaaagcgagaugauuaucccgaagauuuauggaggcccuaucucucaacacaauuaccgccccggguacuucacacagaccgcgggaccuuggcaucucggcaaacuggagcuugauuuugaccugugcgaagggacgaccgugguuguggaugagcacugcggaaaccggggccccagccucagaacaaccacagucaccggcaagauuauccacgaaugguguugccgguccuguacgcugccuccccugcgcuucagaggggaggacggaugcugguauggcauggagauccggccggugaaagaaaaggaggaaaaucuuguuaagagcauggugucugcuggguccggagaggucgacagcuuuucccucggccugcuguguauuucuaucaugauugaagaggugaugagaagccgcuggucccggaaaaugcucaugacagggacccuggccguuuucuuucuucugaucaugggacagcucacauggaacgaucugauuagacugugcaucauggugggcgccaaugcuucugaccgcaugggcauggggaccaccuaccuugcccugauggcgacauucaagaugagaccuauguuugcugucggacuccuguuccggcgccucacgagcagagaggugcugcuucugaccauuggccucucccugguggccucugucgaacugcccaacagccuugaggaacugggggauggacucgccaugggcaucaugauccugaaacuccugacagacuuucaaucccaucagcuuugggcuacccugcucagccugacauucauuaagaccacguuuucucugcacuaugccuggaaaacaauggcuaugguucuuuccaucgugagccuguucccccucugucugucuaccaccucccagaagacaaccuggcucccugugcugcuugggagccugggaugcaagccgcugacaauguuucucauugccgagaauaaaaucuggggccggaagucuuggccccugaacgaaggcauuauggcggucgggaucguguccauccuucugagcucccuccugaaaaacgauguuccucucgccggaccccugauugcuggcgggaugcuuaucgccuguuacgugauuagcggaucuagcgcugaccugucccuggagaaggccgccgaggucucuugggaagaggaagcugagcauagcggcgcgucccacaauauccucguggaaguucaggaugacgggacgaugaaaauuaaggaugaggagcgcgacgauacccugacaauccuucugaaagccacccuccuggcugugucuggagucuauccucucagcauccccgccacacuguucgugugguacuucuggcaaaagaagaaacagagauccggcguccuuugggacaccccuucucccccggaaguggagcgggccguucuggaugacggcauuuaucgcaucaugcagagagggcugcucggacggagccaggugggcgucgggguguuucaagaaaacguuuuccauacgauguggcacgugacccgcggagcuguccugauguaccagggcaagagacuugagccuuccugggccagcgugaaaaaggaccugauuucuuacgggggaggcuggcggcuccagggcuccuggaauacaggggaggaagugcagguuaucgcggucgagcccggcaaaaacccuaagaaugugcaaaccgcucccggcacauuuaagaccccggaaggggaggugggagccauugcccuggauuucaaaccuggcacaagcgggucucccaucgucaacagagaaggaaagauugugggccucuauggcaaugggguugugacgaccuccggaacauacgucagcgcuaucgcccaggcgaaggcuucccaggagggcccucugcccgagaucgaagacgagguguuucgcaagcggaaccuuaccauuauggaucugcaccccgggucuggaaaaaccagacgcuaucugccugccaucguucgggaagccauuaagagaaagcuccgcacacugauccuugcuccgacgcggguggucgccagcgagauggcugaagcccugaaaggcaugcccauuagauaccaaaccacagcggugaaguccgagcauaccgggaaagagaucguugaccucaugugccacgccacauucaccaugcgccugcugagcccugugcggguccccaauuauaacaugaucauuauggaugaagcucauuuuacggacccuucuuccaucgccgcuagaggcuacauuagcacacgggugggaaugggcgaggccgccgcuaucuucaugaccgcgacacccccugggucuguggaagccuuuccgcagagcaaugcugucauucaggaugaggaacgcgacauccccgagagauccuggaacucuggauaugauuggaucacagacuucccuggcaagaccguuugguuugugcccagcauuaaauccgggaaugauaucgccaacugucuccggaagaauggaaagcgcgugauucagcuuucuagaaaaacauucgacaccgaguaccaaaagacgaaaaacaacgacugggauuacgucgugacaaccgacaucagcgaaaugggcgccaauuuccgggcugauagaguuauugacccucgccggugccugaagcccgugauccugaaagaugggccggagagagucgugcucgccggcccuaugcccguuacaguggcguccgcugcccagcgccggggaagaauuggccgcaaccacaauaaggaaggggaccaguauaucuacaugggacagccccugaacaaugaugaggaccaugcccacuggaccgaggcuaagaugcuucuggauaacaucaauacgccugaaggcauuauccccgcccucuuugagccugaacgggagaaaagcgcggccauugacggggaauauagacugcgcggagaggcuagaaagaccuucgucgagcugaugcggcgcggcgaucucccgguguggcuuucuuacaaagucgccuccgaaggguuucaauauagcgacagacgguggugcuucgauggcgagcgcaacaaucaggugcuggaagagaacauggacguugaaaucuggacaaaggagggagagcgcaagaaacugcggcccagauggcucgacgcucgcaccuacuccgauccucuggcccuucgggaauuuaaagaguucgcugccggcagacgcucugugagcggggaccugauucucgaaaucggaaagcugccccagcaccugacacagcgggcgcaaaaugcccucgauaaccuugugaugcugcauaauuccgagcagggcgggagagcuuaucggcacgccauggaagaacugccugacaccaucgagacacucaugcugcuugcucugauugccguccucaccggaggcguuacgcuguuuuuccugucuggccgcgggcucggaaagacaagcaucggccuucugugugugauggccuccagcgugcugcucuggauugcuucugucgaaccccauuggaucgcggccuccauuauccuggaguuuuuccuuauggugcugcucaucccggaaccugauagacagcggacaccccaggacaaccaacuggcuuacguugugauugggcugcucuuuaugauccuuaccgucgccgccaaugagaugggacugcuggagacaaccaaaaaggaucucggcauugggcacguggcugucgaaaaccaccaucacgccgcgauccuggacguggaucuucauccugccagcgcuuggacacuguacgccguugcuacgaccauuaucacacccaugaugcgccacaccauugagaacacaaccgccaauaucucucucacggcgaucgccaaccaggcugccauucugaugggacuggacaaaggcuggccuaucuccaagauggauauuggcgugccccuccuugcucuggggugcuauagccaggucaauccgcugacccucacagccgcugugcugaugcuuguugcccauuacgcgaucauuggaccuggccugcaagccaaagcuaccagagaagcccagaagcggacagcugccgggaucaugaagaaccccaccguggacggaaucgucgccauugaucucgaccccgugguguaugacgcgaaauucgagaagcagcugggccagaucaugcugcucauucuuuguacgucucaaauccugcugaugcgcacaaccugggcucucugcgaaagcauuacacuggccaccgggccucuuaccacacuguggaaaggauccccgggcaaguuuuggaauacgaccaucgcuguuucuauggccaacaucuucagaggcagcuaccucgccggggcuggacuggccuucucccugaugaaaagccucggcgggggacggcgcggcacaggggcgcagggagagacccuuggcgagaaguggaagagacagcugaaucagcuguccaaaucugaauuuaacacauauaagcggagcggcauuauggaggucgauagauccgaagccaaagaggggcucaagcgcggagaaaccacgaaacacgcugugucucggggcacagccaagcugagaugguucguggagcgcaaucuugucaagcccgaggggaaaguuaucgaccugggauguggcagagggggauggagcuacuauugcgcuggccucaagaaagugaccgaagugaagggcuacaccaaagggggaccuggccacgaggaacccauuccuauggccacauacggguggaaccuggucaagcuguauuccggaaaagauguguuuuucauucccccugagaagugugacacccuccuuugcgauauuggcgaaucuagcccgaaucccacaaucgaggaggggagaacgcugcgcguucugaagaugguggaaccuuggcuccggggaaaccaauuuuguauuaaaauccugaaucccuacaugccuuccgucguggagacccuugaacagaugcagagaaagcauggcggcaugcugguucgcaacccccucagcagaaauucuacacacgagauguauuggguguccugcgggaccggaaacaucgucagcgcggugaauaugacaucuagaaugcugcugaaccgcuucaccauggcccaucggaaaccgacguacgagagagacguggaucucggcgcugggacccgccacgucgccguugaaccugagguggcuaaccuggacauuaucggacagagaauugaaaauaucaagcacgagcauaaauccacauggcacuaugaugaagacaaccccuacaagaccugggccuaucauggcagcuacgaggugaagcccucuggguccgcuagcuccauggucaauggagugguuaaacuucugacaaagccuugggaugugauucccauggucacccaaaucgccaugacagacaccacgccuuuuggccagcagcggguguucaaagagaagguugacacacgcaccccgaaagcgaagagaggcaccgcccaaaucauggaagugacagcucgguggcucuggggguuucugagcagaaacaagaaaccccggauuuguacgcgcgaggaguucaccagaaagguccggucuaaugccgcuaucggagccguguuuguugaugagaaccaguggaauagcgccaaagaagcgguggaggacgagcgcuucugggaucuuguccacagagaacgggagcugcauaagcagggcaaaugcgcuacaugcguguacaacaugauggggaagcgcgaaaagaaacucggagaguuuggcaaggccaaaggguccagagccauuugguauauguggcugggcgcucgguuccuggaguucgaggcccucggauuuaugaaugaggaccacugguucucucgcgaaaacagccuguccggcgucgagggggaaggacuucacaagcugggcuacauccucagagauauuucuaaaaucccugggggaaauauguaugcugacgauaccgccggcugggacacacggaucaccgaggaugaccugcagaacgaggcgaagauuacagauaucauggaacccgagcaugcccuucuggcuaaagccauuuuuaagcucaccuaccaaaauaaggugguucgcgugcagagaccugcuaaaaacgggacggucauggacgugaucagccggcgcgaucagagaggcuccggacaggugggcaccuaugggcugaauacauucaccaacauggaagcccaacugauucggcagauggagucugaaggaaucuuuagccccuccgagcucgagacaccgaaccuggcggaaagaguucuugacuggcuggagaaguacggcguggaacgccucaaacggauggccaucagcggggacgauugugucgugaagccuauugacgauagauucgcuaccgcccugacggcucuuaaugacaugggaaaaguucgcaaggauaucccccagugggagccuucuaagggcuggaacgacuggcagcaagugcccuuuugcucccaccauuuccaccagcugauuaugaaagaugggcgggaaaucgucgugccuuguagaaaucaggacgagcucgucggccgcgcccgggugagccagggagcuggcuggucucugagagagacagccugccuggggaaguccuaugcgcaaauguggcagcucauguacuuucaccgccgggaucugagacuugccgcuaacgccauuuguagcgccguucccguggacugggucccgaccucccgcacaaccuggucuauccaugcucaccaucaguggaugacgaccgaagauaugcugagcguguggaaucggguuuggauugaggaaaacccuuggauggaggacaaaacacacaucuccagcugggaagacgugcccuaccucggaaagagagaggaucaauggugcggcucucugaucgggcuuaccgcccgggcgacaugggcuaccaauauucaggucgccaucaaccaggugagacgccugauuggaaaugagaacuaucucgacuacaugacauccaugaaacgguucaagaaugaaagcgaucccgagggcgcccugugguga

SEQ ID NO: 18458 - RNA, 9879 nt, Artificial Sequence
  derived and/or modified CDS sequence (opt5) from DENV-1__JX669462__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggcggcagauucagcgcguugagacaugggcucuuagacaccccggcuucaccgugaucgccuuuuuccuggcgcaugccauugggacaucuaucacccagaaaggaaucauuuuuauccuccugaugcuugucaccccuagcauggcuaugcggugcgugggcauugggaaccgcgacuucguugagggacuguccggcgccacauggguggaugucgugcucgaacacgggagcugugugacgaccauggcuaagaauaagcccacacuggacaucgagcugcucaaaaccgaagucacaaacccugccguucugagaaagcuuugcauugaggcgaaaaucucuaauaccacgacagauucccgguguccgacccaaggagaagccacccugguggaggagcaggacgcuaacuuugugugccgcagaacauucgucgaucggggcuggggcaauggguguggacucuuuggcaaggggagccugcuuaccugcgccaaauucaagugcgugacaaagcuggaaggaaaaauuguucaguacgagaaccucaaguauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccgcacaggccuggacuuuaacgagauggugcuucugaccaugaaagagaagucuuggcucguccauaaacagugguuccuggaucuuccucugcccuggacguccggggcuagcacaucccaagaaaccuggaauagacaggaccuccuggugacauuuaagaccgcgcacgccaaaaagcaggaggucgugguucugggaucucaagaaggcgcuaugcacaccgcccucacaggggccacggagauucagaccagcggaacaaccacaaucuucgcuggccaucugaagugccggcuuaaaauggauaagcugacccucaaagggauguccuaugugauguguacgggcagcuucaagcuggaaaaagaggucgccgagacacagcacggaaccgugcugguucaggugaaguacgaaggcaccgacgcgccgugcaagauuccuuuuucuacacaagaugagaaaggggucacccagaacggaagacuuaucacagcuaaucccaucgugacggacaaggaaaaaccugugaacauugagaccgagccccccuucggcgaauccuauaucguugucggggccggagagaaggcccucaaacugagcugguuuaagcgcggcucuagcauugggaagauguucgaagcuacagcccggggcgcuagacgcauggccauccugggagauaccgcgugggacuuuggcuccauugggggaguguucacaucugugggcaaacucguccaucagguguuugggaccgccuacggaguucuguucagcggcguguccuggacgaugaagaucgggaucggcauucuucugaccuggcucggacugaauagccggucuacaucccugagcaugaccuguaucgcugucggcauggugacacuuuaccucgggguuauggugcaggccgauucuggaugcgucauuaacuggaaaggcagagagcugaaguguggguccggaaucuuugugaccaacgaaguucacacauggaccgagcaauauaaauuccaggcugacagcccuaagcgccuguccgccgcgauuggcaaggccugggaggaaggggugugcggcauccggucugcuacgagacucgagaauauuauguggaaacagaucagcaacgaacugaaucauauccuucuggagaacgauaugaaguuuacagucguggugggagacgccaauggcauucucgcucaggggaaaaagaugauccgcccgcaacccauggaacacaaauacuccuggaagucuuggggaaaagccaagauuaucggcgccgacauucagaacaccaccuucaucaucgaugggccugacacacccgaguguccugauggacagcgggcuuggaauauuugggaggucgaagacuauggcuuuggcguuuucaccacgaacaucuggcugaagcugagagauagcuacacacagaugugcgaccaccgccuuauguccgcggccauuaaagauagcaaggcugugcaugccgacaugggguauuggaucgagucugaaaaaaaugagaccuggaagcucgcccgggcuuccuucauugaagugaaaacauguaccuggcccaagagccacacacuguggucuaacggaguccuggaguccgagaugaucaucccgaagauuuuuggcgggccuaucagccaacauaauuacagacccggauauuucacccagacggccggcccuuggcaccucgggaaacuggaacuugauuuugaccugugcgagggaaccacagugguuguggaugaacacugcggcaaccggggccccucucuccgcaccacaaccgucacggggaagauuauccaugagugguguugcagaagcuguacacugccuccccugcgguucagaggagaggacggcugcugguacgggauggaaauucgcccggugaaagagaaggaagagaaucuuguucgguccauggugagcgcgggaucuggcgaagucgauuccuuuagccucgggauccuguguguguccaucaugauugaggagguuaugagaucucgcuggagcagaaaaaugcugaugaccggaacacucgcuguguuccugcuucugaucaugggccagcucaccuggaacgaccugauucggcugugcaucauggucggcgccaaugccuccgaccgcauggggaugggaaccacauaccuugcucugauggccacgcucaagaugagaccuauguuugcggugggccugcucuuccggcgccugaccucuagagaagugcuucugcucacaauugggcugagccuggucgcuuccguugagcuucccaacucucuggaagagcucggagauggccuggccauggggaucaugaugcucaagcugcuuaccgaauuucaaccccaccagcuguggacaacccuccugagccugacguucgugaaaacaacccuuucccuggacuaugccuggaagaccacagcuauggugcucagcauugucucucuguuuccucucugucuguccaccacaagccagaaaacgaccuggcuuccggugcugcugggaucuuucggcugcaagccccucacaauguuucugaucaccgagaacaaaaucuggggccggaaguccuggccucuuaaugaggggauuauggccaucggaauuguuagcauccugcucucuucccugcucaagaacgaugugccccuggcuggcccucuuauugccgggggaaugcugaucgcguguuacgucaucagcggcuccagcgccgaccugucucucgaaaaagcugccgaggugagcugggaacaggaggcugaacauuccggggccucucacaauauucugguugaggugcaagaugacggaacaaugaagaucaaagaugaggaacgcgacgauacccuuacgauucugcucaaggccacccugcucgcugucagcggcguguaucccauguccaucccugcgacacuguucgucugguacuucuggcagaaaaagaaacagagaucuggcgugcuuugggacacccccagcccgccugagguugaacgggccgugcuggaugacgggauuuaucgcauccugcagagaggacuccugggccggucccaagucggggugggaguuuuucaggauggcguguuccauacaauguggcacgucaccagaggggcugugcuuauguaccagggaaagcgccuggagcccucuugggccagcgugaagaaagaccucaucuccuauggcggcggguggcgguuucagggaagcuggaacacaggcgaggaaguucaagucauugccguggagccugggaagaaucccaaaaacgugcagacgaccccgggaacauucaagaccccugaaggcgaggucggggcuaucgcccuggacuuuaaacccggaaccucuggcuccccuauugugaauagagaaggcaagaucguugggcucuacggaaacggcguggucacaacgagcgggaccuacgugucugcgauugcucaggccaaggccucccaagagggaccccugcccgagaucgaagaugagguuuucaaaaagcgcaaucuuacaauuauggaccugcacccuggcagcgggaaaacccggagauaucugccggcuaucgugcgcgaagccaucaagcggaaacucagaacacugauucuugcgcccacccgcgucguggcuuccgagauggccgaagcccugaagggcaugccuauccgguaccagacgacagcuguuaagucugagcauaccggaagagagauuguggaucucaugugccacgccaccuuuacaaugcggcugcugagccccguccgcgugccuaacuauaauaugaucauuauggacgaagcucauuucaccgaucccgccuccaucgcggccagaggcuacaucagcacacggguggggaugggagaggcugccgcuauuuuuaugaccgccacgccuccgggcucugucgaagccuucccccaguccaacgcuguuauccaggacgaggaacgcgauauuccugagagaagcuggaauucuggguaugacuggaucacagauuuucccggaaaaaccgugugguucgugccuagcauuaaguccggcaacgacaucgcgaauugucuccggaaaaacgggaagagagucauccaacuuucucgcaaaacauucgauaccgaguaccagaagacgaagaacaaugacugggacuaugugguuaccacagauauuagcgaaaugggcgccaacuuucgggcugacagagugaucgauccccgccggugccugaaaccggucauucugaaggacggaccugagagagugauccucgccggccccaugcccguuaccguggccuccgcugcccagcgccgggggagaauuggacgcaaucagaacaaagaaggcgaucaauacgucuacauggggcagccucugaauaacgacgaggaucacgcgcauuggacagaggcuaagaugcuucuggacaauaucaacacccccgaaggaauuaucccugcccucuucgagccggaaagagagaaaucugccgcuaucgauggcgaauaucggcugcgcggggaggccagaaagacauuuguggagcugaugcggcgcggcgaccuccccgucuggcuuagcuacaagguggcguccgaaggauuccaguauagcgauagacgguggugcuuugacggcgagagaaauaaccagguucuggaagagaauauggauguggaaauuuggaccaaagagggggagcgcaagaaacugcggccuagauggcucgacgcccgcacguacucugacccccuggcucuucgggaauucaaggaguuugccgcuggaagacgguccgugagcggcgaucugauccucgaaauugggaaacugccucaacaccugacacuccgcgcccagaacgcucuugacaaucuggucaugcugcacaacuccgagcagggaggcaaggccuauagacaugcgauggaagagcuccccgauaccaucgagacccugaugcuucuggcccucauugcuguucugacaggcggggugacccuguucuuucucucuggaaaaggccuugggaagacaagcaucggacugcugugugugacggccuccucugcucuccuguggauggccagcgucgaaccgcacuggaucgccgcuuccauuauccuugaguucuuucugauggugcuccugauuccugaacccgaccggcagcgcaccccucaagauaaucagcuggcguacguugugaucggccuccuuuucaugauucugacagucgccgcuaacgagauggggcugcucgagaccacaaagaaagaccugggaaucggcuauguggccgccgaaaaccaucagcacgcuaccaugcuugaugucgaccugcaccccgccagcgcguggacgcucuacgccguggcuaccacaguuaucaccccuaugaugagacauacaauugagaauaccacggccaacaucucucugacagcuauugccaaucaagcggccauccugaugggccucgauaagggguggcccauuuccaaaauggacaucggagugccgcuucuggcucugggcugcuacagccaggucaacccucucacccugacagccgcugugcuuaugcugguugcccacuaugcuauuaucgggcccggacuccaggccaaggcgacccgggaagcccagaaacgcaccgcugccggcaucaugaagaaucccacaguggaugggauugucgcuaucgaccuggauccugugguguacgacgccaaguuugagaaacaacugggacagauuaugcuccuuauccuguguacgucucagauucugcucaugagaaccacaugggcccugugcgaauccaucacccuugcgacaggcccgcugaccacgcucugggagggcagccccgggaaguucuggaacacaaccaucgcuguuucuauggccaauauuuuccggggaagcuaucuggcuggcgccgggcuggccuuuucccucaugaaaucucuuggaggcgggcgcagaggaaccggcgcucagggcgagacacugggggaaaaguggaaacggcaacugaaccagcucagcaaguccgaguucaauaccuacaagagaagcggaaucauggaagucgaccgcuccgaggccaaagaaggccugaagcggggggagacaacgaaacaugcggugucuagaggaaccgccaagcuucgcugguuuguggagcggaaccuggucaaaccugaaggcaagguuauugaucucggguguggaagaggcggcuggagcuauuacugcgcugggcugaagaaagugacagaggugaagggauauaccaaaggcgggcccggacacgaagagccuauccccauggccacauacggcuggaaucuggucaagcuccauuccgggaaagacguguucuuuaugccuccggaaaagugugauacccuucugugcgacauuggagagucuagccccaacccuacgaucgaggaaggccgcacccugcggguucucaaaaugguggagcccuggcugagaggcaaucaguucuguaucaagauucuuaacccuuacaugcccuccgucguggaaacacuggagcagaugcaacgcaagcacgggggaaugcucguucggaauccgcugucuagaaacagcacccacgagauguauuggguguccugcggcacagggaauaucgucagcgcugugaacaugaccucucgcaugcugcucaaccgguuuacaauggcccauagaaaaccuaccuacgaacgcgauguggaccugggagcgggcacgagacacgucgccguugagcccgaaguggcuaaucuugauauuaucgggcagcggauugagaacaucaagaaugaacauaaauccacauggcacuaugacgaggauaaccccuacaagaccugggccuaucacggaagcuacgaggugaaaccuucuggcuccgcuagcucuauggucaauggcgugguucgccugcucaccaagcccugggacgugauuccuauggucacacagaucgccaugacggauaccacaccguucgggcaacagagaguguuuaaggaaaaaguugacacccggacacccagagcuaagcggggaaccacacagaucauggaggugaccgccaaauggcuguggggcuuccuuucccgcaacaagaaaccuagaauuuguacgcgggaagaguuuacccgcaaggucagaagcaaugcggccaucggggcuguguucguugacgaaaaccaguggaauuccgccaaggaggcuguggaggaugaacgguuuugggaccugguccaucgcgagagagaacuccacaaacaaggaaagugcgccacaugcguguauaacaugaugggcaaacgggagaagaaacugggggaauucggcaaggccaagggaagccgcgcgauuugguacauguggcugggcgcuagauuccucgaguuugaggcccugggguucaugaaugaagaucauugguuuucucgggagaacagccuuuccggagucgaaggcgaggggcugcacaaacucggauacauccugcgcgacauuucuaagauccccggcgggaauauguaugccgaugacaccgcuggcugggauacaagaaucaccgaggacgaucuucagaacgaagccaaaauuacggacaucauggagccugaacaugcucugcucgccacaagcauuuucaagcugaccuaccagaauaaagugguucgggugcagcgccccgcgaagaacggaacagucauggaugugaucuccagacgggaccaaagaggcucugggcaggugggaaccuauggccugaacacguuuaccaauauggagguucagcucauucgccagauggaaagcgaggggaucuuccugccguccgagcuugaaacaccuaaccuggccgagcgggcucucgauuggcuggaaaaacacggagccgagagacuuaagcgcauggcuaucucuggcgacgacuguguggucaagcccauugaugaccgguuugccaccgcgcugacagcccucaaugauauggggaaagugagaaaggacaucccucaaugggaacccagcaaaggcuggaacgauuggcagcagguuccuuucugcucccaccauuuucaccagcugauuaugaaggacggacgcgagaucgugguccccugucggaaucaagaugagcuggugggcagagcucgcgucagccagggggccggauggucucuccgggaaaccgcuugccugggcaaauccuacgcccagauguggcaacuuauguauuuccauagacgcgaccugcggcucgcugccaacgcgauuuguagcgccgugccgguugauugggugccugcuucuagaacaaccugguccauccacgcccaccaucaguggaugacgacagaggacaugcugagcgucuggaaucggguguggaucgaagagaaccccuggauggaagauaagacccacguuuccucuugggaggaggugcccuaccuugggaagagagaagaccaguggugcggaagccugauuggccucaccgcccgcgcuacaugggccaccaauauccaggucgcgauuaaccaagugcggagacugaucgggaaugagaacuaucuggacuacaugacauccaugaaacgcuuuaagaaugaaagcgauccugagggcgcucucugguga

SEQ ID NO: 18459 - RNA, 9879 nt, Artificial Sequence
  derived and/or modified CDS sequence (opt5) from DENV-1__JX669463__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggcggcagauucagcgcguugagacaugggcucuuagacaccccggcuucaccgugaucgccuuuuuccuggcgcaugccauugggacaucuaucacccagaaaggaaucauuuuuauccuccugaugcuugucaccccuagcauggcuaugcggugcgugggcauugggaaccgcgacuucguugagggacuguccggcgccacauggguggaugucgugcucgaacacgggagcugugugacgaccauggcuaagaauaagcccacacuggacaucgagcugcucaaaaccgaagucacaaacccugccguucugagaaagcuuugcauugaggcgaaaaucucuaauaccacgacagauucccgguguccgacccaaggagaagccacccugguggaggagcaggacgcuaacuuugugugccgcagaacauucgucgaucggggcuggggcaauggguguggacucuuuggcaaggggagccugcuuaccugcgccaaauucaagugcgugacaaagcuggaaggaaaaauuguucaguacgagaaccucaaguauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccgcacaggccuggacuuuaacgagauggugcuucugaccaugaaagagaagucuuggcucguccauaaacagugguuccuggaucuuccucugcccuggacguccggggcuagcacaucccaagaaaccuggaauagacaggaccuccuggugacauuuaagaccgcgcacgccaaaaagcaggaggucgugguucugggaucucaagaaggcgcuaugcacaccgcccucacaggggccacggagauucagaccagcggaacaaccacaaucuucgcuggccaucugaagugccggcuuaaaauggauaagcugacccucaaagggauguccuaugugauguguacgggcagcuucaagcuggaaaaagaggucgccgagacacagcacggaaccgugcugguucaggugaaguacgaaggcaccgacgcgccgugcaagauuccuuuuucuacacaagaugagaaaggggucacccagaacggaagacuuaucacagcuaaucccaucgugacggacaaggaaaaaccugugaacauugagaccgagccccccuucggcgaauccuauaucguugucggggccggagagaaggcccucaaacugagcugguuuaagcgcggcucuagcauugggaagauguucgaagcuacagcccggggcgcuagacgcauggccauccugggagauaccgcgugggacuuuggcuccauugggggaguguucacaucugugggcaaacucguccaucagguguuugggaccgccuacggaguucuguucagcggcguguccuggacgaugaagaucgggaucggcauucuucugaccuggcucggacugaauagccggucuacaucccugagcaugaccuguaucgcugucggcauggugacacuuuaccucgggguuauggugcaggccgauucuggaugcgucauuaacuggaaaggcagagagcugaaguguggguccggaaucuuugugaccaacgaaguucacacauggaccgagcaauauaaauuccaggcugacagcccuaagcgccuguccgccgcgauuggcaaggccugggaggaaggggugugcggcauccggucugcuacgagacucgagaauauuauguggaaacagaucagcaacgaacugaaucauauccuucuggagaacgauaugaaguuuacagucguggugggagacgccaauggcauucucgcucaggggaaaaagaugauccgcccgcaacccauggaacacaaauacuccuggaagucuuggggaaaagccaagauuaucggcgccgacauucagaacaccaccuucaucaucgaugggccugacacacccgaguguccugauggacagcgggcuuggaauauuugggaggucgaagacuauggcuuuggcguuuucaccacgaacaucuggcugaagcugagagauagcuacacacagaugugcgaccaccgccuuauguccgcggccauuaaagauagcaaggcugugcaugccgacaugggguauuggaucgagucugaaaaaaaugagaccuggaagcucgcccgggcuuccuucauugaagugaaaacauguaccuggcccaagagccacacacuguggucuaacggaguccuggaguccgagaugaucaucccgaagauuuuuggcgggccuaucagccaacauaauuacagacccggauauuucacccagacggccggcccuuggcaccucgggaaacuggaacuugauuuugaccugugcgagggaaccacagugguuguggaugaacacugcggcaaccggggccccucucuccgcaccacaaccgucacggggaagauuauccaugagugguguugcagaagcuguacacugccuccccugcgguucagaggagaggacggcugcugguacgggauggaaauucgcccggugaaagagaaggaagagaaucuuguucgguccauggugagcgcgggaucuggcgaagucgauuccuuuagccucgggauccuguguguguccaucaugauugaggagguuaugagaucucgcuggagcagaaaaaugcugaugaccggaacacucgcuguguuccugcuucugaucaugggccagcucaccuggaacgaccugauucggcugugcaucauggucggcgccaaugccuccgaccgcauggggaugggaaccacauaccuugcucugauggccacgcucaagaugagaccuauguuugcggugggccugcucuuccggcgccugaccucuagagaagugcuucugcucacaauugggcugagccuggucgcuuccguugagcuucccaacucucuggaagagcucggagauggccuggccauggggaucaugaugcucaagcugcuuaccgaauuucaaccccaccagcuguggacaacccuccugagccugacguucgugaaaacaacccuuucccuggacuaugccuggaagaccacagcuauggugcucagcauugucucucuguuuccucucugucuguccaccacaagccagaaaacgaccuggcuuccggugcugcugggaucuuucggcugcaagccccucacaauguuucugaucaccgagaacaaaaucuggggccggaaguccuggccucuuaaugaggggauuauggccaucggaauuguuagcauccugcucucuucccugcucaagaacgaugugccccuggcuggcccucuuauugccgggggaaugcugaucgcguguuacgucaucagcggcuccagcgccgaccugucucucgaaaaagcugccgaggugagcugggaacaggaggcugaacauuccggggccucucacaauauucugguugaggugcaagaugacggaacaaugaagaucaaagaugaggaacgcgacgauacccuuacgauucugcucaaggccacccugcucgcugucagcggcguguaucccauguccaucccugcgacacuguucgucugguacuucuggcagaaaaagaaacagagaucuggcgugcuuugggacacccccagcccgccugagguugaacgggccgugcuggaugacgggauuuaucgcauccugcagagaggacuccugggccggucccaagucggggugggaguuuuucaggauggcguguuccauacaauguggcacgucaccagaggggcugugcuuauguaccagggaaagcgccuggagcccucuugggccagcgugaagaaagaccucaucuccuauggcggcggguggcgguuucagggaagcuggaacacaggcgaggaaguucaagucauugccguggagccugggaagaaucccaaaaacgugcagacgaccccgggaacauucaagaccccugaaggcgaggucggggcuaucgcccuggacuuuaaacccggaaccucuggcuccccuauugugaauagagaaggcaagaucguugggcucuacggaaacggcguggucacaacgagcgggaccuacgugucugcgauugcucaggccaaggccucccaagagggaccccugcccgagaucgaagaugagguuuucaaaaagcgcaaucuuacaauuauggaccugcacccuggcagcgggaaaacccggagauaucugccggcuaucgugcgcgaagccaucaagcggaaacucagaacacugauucuugcgcccacccgcgucguggcuuccgagauggccgaagcccugaagggcaugccuauccgguaccagacgacagcuguuaagucugagcauaccggaagagagauuguggaucucaugugccacgccaccuuuacaaugcggcugcugagccccguccgcgugccuaacuauaauaugaucauuauggacgaagcucauuucaccgaucccgccuccaucgcggccagaggcuacaucagcacacggguggggaugggagaggcugccgcuauuuuuaugaccgccacgccuccgggcucugucgaagccuucccccaguccaacgcuguuauccaggacgaggaacgcgauauuccugagagaagcuggaauucuggguaugacuggaucacagauuuucccggaaaaaccgugugguucgugccuagcauuaaguccggcaacgacaucgcgaauugucuccggaaaaacgggaagagagucauccaacuuucucgcaaaacauucgauaccgaguaccagaagacgaagaacaaugacugggacuaugugguuaccacagauauuagcgaaaugggcgccaacuuucgggcugacagagugaucgauccccgccggugccugaaaccggucauucugaaggacggaccugagagagugauccucgccggccccaugcccguuaccguggccuccgcugcccagcgccgggggagaauuggacgcaaucagaacaaagaaggcgaucaauacaucuacauggggcagccucugaauaacgacgaggaucacgcgcauuggacagaggcuaagaugcuucuggacaauauuaacacccccgaaggaaucaucccugcccucuucgagccggaaagagagaaaucugccgcuauugauggcgaauaucggcugcgcggggaggccagaaagacauuugucgagcugaugcggcgcggcgaccuccccguguggcuuagcuacaaggucgcguccgaaggauuccaguauagcgauagacgguggugcuuugacggcgagagaaauaaccaggugcuggaagagaauauggauguugaaaucuggaccaaagagggggagcgcaagaaacugcggccuagauggcucgacgcccgcacguacucugacccccuggcucuucgggaauucaaggaguuugccgcuggaagacgguccgugagcggcgaucugauucucgaaaucgggaaacugccucaacaccugacacuccgcgcccagaacgcucuugacaaucuggugaugcugcacaacuccgagcagggaggcaaggccuauagacaugcgauggaagagcuccccgauaccauugagacccugaugcuucuggcccucaucgcuguccugacaggcgggguuacccuguucuuucucucuggaaaaggccuugggaagacaagcaucggacugcugugugugacggccuccucugcucuccuguggauggccagcguggaaccgcacuggauugccgcuuccaucauucuugaguucuuucugaugguccuccugaucccugaacccgaccggcagcgcaccccucaagauaaucagcuggcguacgugguuauuggccuccuuuucaugauccugacaguggccgcuaacgagauggggcugcucgagaccacaaagaaagaccugggaaucggcuaugucgccgccgaaaaccaucagcacgcuaccaugcuugauguggaccugcaccccgccagcgcguggacgcucuacgccgucgcuaccacagugauuaccccuaugaugagacauacaaucgagaauaccacggccaacauuucucugacagcuaucgccaaucaagcggccauucugaugggccucgauaagggguggcccaucuccaaaauggacauuggaguuccgcuucuggcucugggcugcuacagccaggugaacccucucacccugacagccgcuguccuuaugcugguggcccacuaugcuaucaucgggcccggacuccaggccaaggcgacccgggaagcccagaaacgcaccgcugccggcauuaugaagaaucccacaguugaugggaucguggcuauugaccuggauccugucguguacgacgccaaguuugagaaacaacugggacagaucaugcuccuuauucuguguacgucucagauccugcucaugagaaccacaugggcccugugcgaauccaucacccuugcgacaggcccgcugaccacgcucugggagggcagccccgggaaguucuggaacacaaccauugcugugucuauggccaauaucuuccggggaagcuaucuggcuggcgccgggcuggccuuuucccucaugaaaucucuuggaggcgggcgcagaggaaccggcgcucagggcgagacacugggggaaaaguggaaacggcaacugaaccagcucagcaaguccgaguucaauaccuacaagagaagcggaauuauggaaguugaccgcuccgaggccaaagaaggccugaagcggggggagacaacgaaacaugcggucucuagaggaaccgccaagcuucgcugguuuguggagcggaaccuggugaaaccugaaggcaaggucaucgaucucggguguggaagaggcggcuggagcuauuacugcgcugggcugaagaaaguuacagaggugaagggauauaccaaaggcgggcccggacacgaagagccuauucccauggccacauacggcuggaaucuggugaagcuccauuccgggaaagacgucuucuuuaugccuccggaaaagugugauacccuucugugcgacaucggagagucuagccccaacccuacgaucgaggaaggccgcacccugcgggugcucaaaaugguugagcccuggcugagaggcaaucaguucuguauuaagauccuuaacccuuacaugcccuccguggucgaaacacuggagcagaugcaacgcaagcacgggggaaugcucgugcggaauccgcugucuagaaacagcacccacgagauguauuggguuuccugcggcacagggaauauugugagcgcugucaacaugaccucucgcaugcugcucaaccgguuuacaauggcccauagaaaaccuaccuacgaacgcgauguggaccugggagcgggcacgagacacguggccgucgagcccgaaguugcuaaucuugauaucauugggcagcggaucgagaacauuaagaaugaacauaaauccacauggcacuaugacgaggauaaccccuacaagaccugggccuaucacggaagcuacgaggugaaaccuucuggcuccgcuagcucuauggugaauggcgucgugcgccugcucaccaagcccugggacguuaucccuauggugacacagaucgccaugacggauaccacaccguucgggcaacagagagucuuuaaggaaaaaguggacacccggacacccagagcuaagcggggaaccacacagauuauggagguuaccgccaaauggcuguggggcuuccuuucccgcaacaagaaaccuagaaucuguacgcgggaagaguuuacccgcaaggugagaagcaaugcggccauuggggcugucuucguggacgaaaaccaguggaauuccgccaaggaggcuguugaggaugaacgguuuugggaccuggugcaucgcgagagagaacuccacaaacaaggaaagugcgccacaugcgucuauaacaugaugggcaaacgggagaagaaacugggggaauucggcaaggccaagggaagccgcgcgaucugguacauguggcugggcgcuagauuccucgaguuugaggcccugggguucaugaaugaagaucauugguuuucucgggagaacagccuuuccggaguggaaggcgaggggcugcacaaacucggauacauucugcgcgacaucucuaagauccccggcgggaauauguaugccgaugacaccgcuggcugggauacaagaauuaccgaggacgaucuucagaacgaagccaaaaucacggacauuauggagccugaacaugcucugcucgccacaagcaucuucaagcugaccuaccagaauaaagucgugcggguucagcgccccgcgaagaacggaacagugauggaugucauuuccagacgggaccaaagaggcucugggcaggugggaaccuauggccugaacacguuuaccaauauggaggugcagcucauccgccagauggaaagcgaggggaucuuccugccguccgagcuugaaacaccuaaccuggccgagcgggcucucgauuggcuggaaaaacacggagccgagagacuuaagcgcauggcuauuucuggcgacgacuguguugugaagcccaucgaugaccgguuugccaccgcgcugacagcccucaaugauauggggaaagucagaaaggacauuccucaaugggaacccagcaaaggcuggaacgauuggcagcaggugccuuucugcucccaccauuuucaccagcugaucaugaaggacggacgcgagauuguugugcccugucggaaucaagaugagcuggucggcagagcucgcgugagccagggggccggauggucucuccgggaaaccgcuugccugggcaaauccuacgcccagauguggcaacuuauguauuuccauagacgcgaccugcggcucgcugccaacgcgaucuguagcgccgucccgguggauuggguuccugcuucuagaacaaccugguccauccacgcccaccaucaguggaugacgacagaggacaugcugagcguguggaaucgggucuggauugaagagaaccccuggauggaagauaagacccacguguccucuugggaggagguucccuaccuugggaagagagaagaccaguggugcggaagccugaucggccucaccgcccgcgcuacaugggccaccaauauucagguggcgaucaaccaaguccggagacugauugggaaugagaacuaucuggacuacaugacauccaugaaacgcuuuaagaaugaaagcgauccugagggcgcucucugguga

SEQ ID NO: 18460 - RNA, 9879 nt, Artificial Sequence
  derived and/or modified CDS sequence (opt5) from DENV-1__JX669464__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacgugaauggcauccuugcucaggggaagaaaaugauucgcccgcaacccauggagcauaaguauagcuggaaguccuggggaaaagccaagaucauuggcgcugauauccagaacaccaccuuuaucauugacgggccugauacacccgaauguccugacgaucagcgggccuggaauaucugggaggucgaggacuacggauucggcauuuuuaccacgaacaucuggcucaaacugagagauucucacacacagaugugcgaccaccgccugaugagcgccgcuauuaaggauuccaaagcgguucaugccgacaugggcuauuggaucgaaagcgagaagaaugaaaccuggaagcucgcucgggccucuuucaucgaggugaaaacauguauuuggcccaagucccacacccuguggagcaacggggugcuugaaucugagauggucaucccgaaaauuuacggaggcccuaucucccaacauaauuauagacccggguacuucacacagaccgccggaccuuggcaccugggcaagcucgagcuggauuuugaccugugcgaagggacgaccgugguuguggaugagcacugcggauaccgcggccccagccuucggacaaccacagucaccggcaaaauuauccaugaaugguguugcagaucuuguacgcucccuccccugcgguuccgcggggaggacggaugcugguauggcauggagaucagaccggugaaggaaaaggaggaaaaccugguucggagcaugguguccgcugggagcggagagauggacucuuuuucccucggcauucugugugucagcauccuuauugaagaggugaugagaucccgcuggucucggaaaaugcugaugacagggacccucgccguuuuccugcugcuuaucaugggacagcugacauggaaugaucucauuagacugugcaucauggugggcgcgaacgcuagcgaccgcaugggcauggggaccaccuaccucgcccugauggccacauuuaagaugagaccuauguucgcugucggacuucuguuucggcgccucacguccagagaggugcugcugcuuaccgugggccugucucucgucgccagcguugaacugcccaauucccucgaggaacugggggauggacuugcgaugggcauuaugaugcugaaacuccugacagacuuccaaccccaccagcuguggaccacacuucugucucucaccuuuauccggacgagccugucccucgauuaugcuuggaagacaauggccauggcccugagcaucgugucucuuuucccucugugucuguccaccaccagccagaaaacaaccuggcucccggugcugcuugggucuuuuggaugcaagccccugacaauguuccucauuacggagaacaagaucuggggccgcaaauccuggccuauuaacgaaggcaucauggcugucgggauugugagcauccugcucucuucccugcuuaagaaugacguuccccuggccggaccucugaucgcuggcgggaugcucauugccuguuacgugaucagcggauccagcgcggaucugucucuugagaaagccgcugaggucagcugggaagaggaagccgagcauuccggcaccucucacaacauucugguggaaguucaggacgaugggacaaugaagaucaaagacgaggagagagaugacacccucacaauucugcucaaggcuacccugcuugccgugagcggagucuaucccauguccaucccugccacgcuguuugugugguacuucuggcaaaaaaagaagcagcggucuggcguccugugggauacccccagcccgccugaaguggagcgcgcuguucucgacgacggcaucuauagaauucugcagcgggggcuucugggacgcucccaggugggcgucgggguguuccaagauggaguuuuucauacaauguggcacgugaccagaggcgcgguccucauguaccaggggaaacggcuggaacccucuugggccagcgugaagaaagaccucaucuccuacggaggcggcuggagauuccaggggagcuggaauacaggagaggaggugcagguuauugcugucgaaccuggcaagaaccccaaaaaugugcaaaccacaccggggacguuuaagaucccugagggagaagugggcgccauugcccuggauuucaagcccgggaccucuggauccccuaucgucaaccgcgagggcaaaauugugggccuuuaugggaauggaguugugacaaccagcggcaccuacgucucugcuaucgcccaggcgaaggcuacacaggaagggccccugcccgagaucgaggacgaaguguuuaaaaagcggaaccugacgauuauggaucuccacccuggauccggcaaaaccagacgcuaucugccggccaucguucgggaggccauuaagagaaagcuucgcacacugauccucgcucccacccggguggucgccagcgaaauggcggaggcucugaaagggaugccuauuagauaccaaacaaccgccgugaaguccgaacauacgggccgcgagaucguugaccugaugugccacgccacauucaccaugcggcuccuuucucccgugagagucccuaauuauaacaugaucauuauggaugaggcucauuuuaccgaccccgccagcaucgcugcccggggauacauuuccacacgcgugggcaugggggaagcggccgcuaucuucaugaccgccacaccuccgggaagcguggaggcuuuuccccagucuaaugccgucauucaggaugaagagagagacaucccugaacgguccuggaacagcggcuaugauuggaucaccgacuuccccgggaaaacgguuugguuugugccuucuauuaagagcggaaaugacaucgccaacugucugcgcaaaaauggcaagagagugauucagcugucccggaagacauucgauaccgaguaccaaaaaacaaagaacaacgacugggauuacgucgugaccacggacaucucugagaugggggcuaauuucagagcggaucgcguuauugacccccggagaugccucaaaccggugauccugaaggaaggcccugagcgcgucauucuugccggacccaugcccgugaccguugcuagcgccgcccagcggagaggccgcaucgggcggaaccagaauaaagaaggagaucaguauaucuacaugggccaaccucugaacaaugacgaggaucacgcucauuggacagaggccaagaugcuccuggacaacauuaauacccccgaagggaucauuccugcgcuguuugagccggaaagagagaaguccgcugccaucgauggagaauaucgccucagaggcgaggcccggaaaacauucguggagcuuaugcgcagaggggaccugcccgucuggcugucuuacaagguggcuagcgaaggcuuucaguauuccgaucggcgcuggugcuucgacggagagagaaacaaucagguccucgaagagaacauggacguggaaauuuggaccaaagagggcgagcggaagaaacugagaccucgcuggcuugaugcccggacauacagcgacccccuggcgcucagagaauuuaaggaguucgccgcugggcgccggucuguuuccggagaucugauccuggaaaucggcaaacucccucagcaccuuacccugagagcccaaaaugcucuggacaaccucgugaugcugcacaauagcgagcaggggggaaaggccuaucggcaugcuauggaagagcuucccgauacgauugagacacugaugcuccuggcccugaucgcggugcucaccggcggcgucacccuuuuuuuccuguccgggaagggacugggcaaaacaucuauugggcuccuguguguuauggccagcuccgcucuucuguggauggccucuguggaaccgcacuggaucgcugccagcauuauccucgaguuuuuccugauggugcugcucaucccugaacccgaccgccagagaaccccucaggauaaccaacuugccuacgucgugauuggacugcuguuuaugauccucacaguugcugcgaaugagaugggccugcuugagacgaccaagaaagaccuggggauuggacauguggccgucgaaaaccaccaccaugcuacaaugcucgauguggaccugcggcccgccuccgccuggacccuguacgcugucgccacaaccgugaucacgccuaugaugcgccacaccauugagaacacaaccgcgaauaucagccucacagccauugcuaaccaggccgcuauccuuaugggccuggauaagggcuggcccaucucuaaaauggacauugggguuccgcugcucgcccugggaugcuauucccaggugaauccucuuacccugacggcggccguccucaugcugguggcucauuacgccaucauuggccccgggcugcaagcuaaggccacaagagaagcucagaagcggaccgccgcgggaaucaugaaaaaccccacaguugauggcauugugaccaucgaccucgacccugucguguaugaugccaaguucgagaaacagcuugggcagaucaugcugcugauucucuguaccagccaaauccugcuuaugcgcacaacgugggcucugugcgaaucuauuacccucgccacaggaccgcugaccacacugugggagggcucccccggcaaguuuuggaauaccacgaucgcugugagcauggccaacauuuucagagggucuuaccucgccggagcgggccuugcuuucagccugaugaaaucccuggggggaggccggcgcgggacaggagcccagggcgagacccucggcgaaaaguggaagagacagcugaaucagcuuucuaaaagcgaguuuaacaccuauaagaaauccgggaucauggaaguugaccggagcgaggcuaaggaaggacugaaaagaggcgagacaaccaagcacgccgucucccgcgggacagccaagcuccggugguucguggagagaaaucuggugaaaccugaaggaaaggucaucgaucugggcugugggcgcggaggcuggucuuacuauugcgcuggccucaaaaagguuacggaggugaaaggguacaccaagggaggccccgggcaugaagagccuauucccauggccacauacggauggaaccuugugaaacugcacagcggcaaggacgucuuuuucaccccuccggaaaagugugauacacugcucugcgacaucggggaguccucucccaauccuaccauugaggaaggacggacgcugagagugcuuaaaaugguugagcccuggcugcgcggcaaccaauuuuguaucaagauucucaauccuuauaugcccagcguggucgaaacccuggagcagaugcagcggaaacacggcgggaugcuggugagaaacccgcucucccgcaauucuacacaugagauguacuggguuagcugcggaaccggcaacaucguguccgcggucaauaugacaagccggaugcugcuuaacagauucaccauggcccaccgcaagccuacauaugaacgggauguggaccugggggcuggaaccagacauguggccgucgagcccgaaguugcuaaccucgauauuaucggccagcgcaucgagaauauuaaaaacgaacacaagucuacguggcacuacgacgaggauaaucccuauaagacaugggccuaccauggguccuaugaggugaaaccuagcggaucugcguccagcauggugaacggcgucgugagacugcuuaccaagcccugggacguuaucccuauggugacccaaauugccaugacagacacgaccccguuuggccagcagcgggucuucaaagaaaagguggauacacgcacccccagagcuaaacgggggacagcccaaaucauggagguuaccgcuaaguggcuguggggauuucucucuagaaauaagaaaccucggauuuguacacgcgaagaguucaccagaaaggugcgguccaacgccgcuaucggcgccgucuuuguggacgaaaaucaguggaacagcgcgaaagaggccguugaggaugaacgcuucugggaccuggugcacagagagcgggaacugcauaagcaggggaaaugcgcuacgugcgucuacaauaugaugggaaagcgcgagaagaaacucggcgaauuugggaaggccaaaggcuccagagcuaucugguacauguggcugggagcccgguuccuugaguucgaggcccugggcuuuaugaacgaagaucacugguucagccgcgagaauucucucagcgggguggaaggagagggccugcauaagcuuggguauauucugagagacaucuccaaaauucccggaggcaacauguacgcggaugacaccgcugggugggauacacggaucaccgaggacgaucuccagaaugaagccaagauuacagacaucauggagccugaacacgcccugcuggcuaccucuaucuuuaaacucacguaucaaaacaaggucgugcgcguucagagacccgccaagagcggcacagugauggaugucauuucccggcgcgaccagagaggaucuggccagguggggaccuacggacugaauacauucaccaacauggaggugcaacuuauccggcagauggaaagcgagggcauuuuucugccguccgagcucgaaacgccuaaccuggcuaaaaagguucuugacuggcuggagaaacacggggccgaaagacucaagcgcauggcgaucucuggagaugacuguguggucaaacccauugaugaccgguucgccaccgcucugacagcccugaaugauaugggcaaggugagaaaggacaucccucagugggagcccagcaaaggguggaacgauuggcagcaaguuccuuuuugcucccaucacuuccaucagcucaucaugaaggacggccgcgaaauugugguccccugucggaaucaggaugagcuggugggaagagcucgcgucagccagggcgccggguggucucuucgggagaccgcgugccugggaaaauccuaugcccaaauguggcagcucauguacuuucacagacgcgaccugcggcuugcugccaacgcuaucuguagcgccgugccgguugauugggugccuacaucuagaaccacaugguccauucacgcucaucaccaguggaugaccacggaagacaugcugagcgucuggaaucgcguguggaucgaggaaaaccccuggauggaggacaagacacauguuuccucuugggaagaggugcccuaucucggcaaacgggaggaucaauggugcgggagccugauuggacugaccgccagagcgaccugggccacaaauauccaggucgcuauuaaccaggugcggagacucaucggcaaugaaaacuaccuggacuacaugaccuccaugaagcgcuucaagaaugagagcgauccugaaggggcccuuugguga

SEQ ID NO: 18461 - RNA, 9879 nt, Artificial Sequence
  derived and/or modified CDS sequence (opt5) from DENV-1__JX669465__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacgugaauggcauccuugcucaggggaagaaaaugauucgcccgcaacccauggagcauaaguauagcuggaaguccuggggaaaagccaagaucauuggcgcugauacccagaacaccacauuuaucaucgacgggccugauacccccgaauguccugacgaucagcgggccuggaauauuugggaggucgaggacuacggauucggcaucuuuacgacaaacauuuggcucaaacugagagauucucacacccagaugugcgaccaccgccugaugagcgccgcuaucaaggauuccaaagcgguucaugccgacaugggcuauuggauugaaagcgagaagaaugaaacauggaagcucgcucgggccucuuucaucgaggugaaaaccuguaucuggcccaagucccacacacuguggagcaacggggugcuugaaucugagauggucauuccgaaaaccuacggaggcccuaucucccaacauaauuauagacccggguacuucacgcagaccgccggaccuuggcaccugggcaagcucgagcuggauuuugaccugugcgaagggacaaccgugguuguggaugagcacugcggauaccgcggccccagccuucggacaaccacggucacaggcaaaauuauccaugaaugguguugcagaucuuguacccucccuccccugcgguuccgcggggaggacggaugcugguauggcauggagauuagaccggugaaggaaaaggaggaaaaccugguucggagcaugguguccgcugggagcggagagauggacucuuuuucccucggcauccugugugucagcauccuuauugaagaggugaugagaucccgcuggucucggaaaaugcugaugacagggacccucgccguuuuccugcugcuuaucaugggacagcugaccuggaaugaucucauuagacugugcaucauggugggcgcgaacgcuagcgaccgcaugggcauggggacaacguaccucgcccugauggccaccuuuaagaugagaccuauguucgcugucggacuucuguuucggcgccucacauccagagaggugcugcugcuuaccgugggccugucucucgucgccagcguugaacugcccaauucccucgaggaacugggggauggacuugcgaugggcauuaugaugcugaaacuccugacagacuuccaaccccaccagcuguggaccacgcuucugucucucacauuuauccggaccagccugucccucgauuaugcuuggaagaccauggccauggcccugagcauugugucucuuuucccucugugucuguccacaaccagccagaaaacaacguggcucccggugcugcuugggucuuuuggaugcaagccccugaccauguuccucaucacagagaacaagaucuggggccgcaaauccuggccuauuaacgaaggcaucauggcugucgggauugugagcauccugcucucuucccugcuuaagaaugacguuccccuggccggaccucugauugcuggcgggaugcucaucgccuguuacgugaucagcggauccagcgcggaucugucucuugagaaagccgcugaggucagcugggaagaggaagccgagcauuccggcaccucucacaacauucugguggaaguucaggacgaugggacaaugaagaucaaagacgaggagagagaugacacccucacgauucugcucaaggcuacccugcuugccgugagcggagucuaucccauguccaucccugccacacuguuugugugguacuucuggcaaaaaaagaagcagcggucuggcguccugugggauacccccagcccgccugaaguggagcgcgcuguucucgacgacggcauuuauagaauccugcagcgggggcuucugggacgcucccaggugggcgucgggguguuccaagauggaguuuuucauacaauguggcacgugaccagaggcgcgguccucauguaccaggggaaacggcuggaacccucuugggccagcgugaagaaagaccucaucuccuacggaggcggcuggagauuccaggggagcuggaauacaggagaggaggugcagguuauugcugucgaaccuggcaagaaccccaaaaaugugcaaacgaccccggggacauuuaagaccccugagggagaagugggcgccaucgcccuggauuucaagcccgggaccucuggauccccuauugucaaccgcgagggcaaaaucgugggccuuuaugggaauggaguugugacaacgagcggcaccuacgucucugcuauugcccaggcgaaggcuacacaggaagggccccugcccgagaucgaggacgaaguguuuaaaaagcggaaccugaccauuauggaucuccacccuggauccggcaaaacaagacgcuaucugccggccaucguucgggaggccaucaagagaaagcuucgcacccugauucucgcucccacgcggguggucgccagcgaaauggcggaggcucugaaagggaugccuaucagauaccaaacaaccgccgugaaguccgaacauaccggccgcgagauuguugaccugaugugccacgccacauucaccaugcggcuccuuucucccgugagagucccuaauuauaacaugaucauuauggaugaggcucauuuuacagaccccgccagcaucgcugcccggggauacaucuccacccgcgugggcaugggggaagcggccgcuauuuucaugacggccacaccuccgggaagcguggaggcuuuuccccagucuaaugccgucauccaggaugaagagagagacauuccugaacgguccuggaacagcggcuaugauuggaucaccgacuuccccgggaaaacaguuugguuugugccuucuauuaagagcggaaaugacaucgccaacugucugcgcaaaaauggcaagagagugauccagcugucccggaagaccuucgauacggaguaccaaaaaaccaagaacaacgacugggauuacgucgugacaaccgacauuucugagaugggggcuaauuucagagcggaucgcguuaucgacccccggagaugccucaaaccggugauucugaaggaaggcccugagcgcgucauccuugccggacccaugcccgugacaguugcuagcgccgcccagcggagaggccgcauugggcggaaccagaauaaagaaggagaucaguauaucuacaugggccaaccucugaacaaugacgaggaucacgcucauuggaccgaggccaagaugcuccuggacaacauuaauacacccgaagggaucaucccugcgcuguuugagccggaaagagagaaguccgcugccauugauggagaauaucgccucagaggcgaggcccggaaaaccuucguggagcuuaugcgcagaggggaccugcccgucuggcugucuuacaagguggcuagcgaaggcuuucaguauuccgaucggcgcuggugcuucgacggagagagaaacaaucagguccucgaagagaacauggacguggaaaucuggacgaaagagggcgagcggaagaaacugagaccucgcuggcuugaugcccggacauacagcgacccccuggcgcucagagaauuuaaggaguucgccgcugggcgccggucuguuuccggagaucugauucuggaaaucggcaaacucccucagcaccuuacccugagagcccaaaaugcucuggacaaccucgugaugcugcacaauagcgagcaggggggaaaggccuaucggcaugcuauggaagagcuucccgauaccauugagacacugaugcuccuggcccugaucgcggugcucaccggcggcgucacacuuuuuuuccuguccgggaagggacugggcaaaacgucuaucgggcuccuguguguuauggccagcuccgcucuucuguggauggccucuguggaaccgcacuggauugcugccagcaucauucucgaguuuuuccugauggugcugcucaucccugaacccgaccgccagagaaccccucaggauaaccaacuugccuacgucgugauuggacugcuguuuaugauccucacaguugcugcgaaugagaugggccugcuugagaccacaaagaaagaccuggggaucggacauguggccgucgaaaaccaccaccaugcuaccaugcucgauguggaccugcggcccgccuccgccuggacgcuguacgcugucgccaccacagugauuaccccuaugaugcgccacacaaucgagaacaccacggcgaauauuagccucacagccaucgcuaaccaggccgcuauucuuaugggccuggauaagggcuggcccaucucuaaaauggacauugggguuccgcugcucgcccugggaugcuauucccaggugaauccucuuacccugacagcggccguccucaugcugguggcucauuacgccaucaucggccccgggcugcaagcuaaggccaccagagaagcucagaagcggaccgccgcgggaauuaugaaaaaccccacaguugauggcaucgugacgauugaccucgacccugucguguaugaugccaaguucgagaaacagcuugggcagaucaugcugcugauucucuguaccagccaaauccugcuuaugcgcacaaccugggcucugugcgaaucuaucacacucgccaccggaccgcugacgacacugugggagggcucccccggcaaguuuuggaauaccaccauugcugugagcauggccaacaucuucagagggucuuaccucgccggagcgggccuugcuuucagccugaugaaaucccuggggggaggccggcgcgggacaggagcccagggcgagacccucggcgaaaaguggaagagacagcugaaucagcuuucuaaaagcgaguuuaacacauauaagaaauccgggauuauggaaguugaccggagcgaggcuaaggaaggacugaaaagaggcgagacgaccaagcacgccgucucccgcgggacagccaagcuccggugguucguggagagaaaucuggugaaaccugaaggaaaggucaucgaucugggcugugggcgcggaggcuggucuuacuauugcgcuggccucaaaaagguuaccgaggugaaaggguacacaaagggaggccccgggcaugaagagccuauucccauggccaccuacggauggaaccuugugaaacugcacagcggcaaggacgucuuuuucacgccuccggaaaagugugauacccugcucugcgacaucggggaguccucucccaauccuacaaucgaggaaggacggacccugagagugcuuaaaaugguugagcccuggcugcgcggcaaccaauuuuguauuaagauccucaauccuuauaugcccagcguggucgaaacacuggagcagaugcagcggaaacacggcgggaugcuggugagaaacccgcucucccgcaauucuacccaugagauguacuggguuagcugcggaacaggcaacauuguguccgcggucaauaugaccagccggaugcugcuuaacagauucacgauggcccaccgcaagccuacauaugaacgggauguggaccugggggcuggaaccagacauguggccgucgagcccgaaguugcuaaccucgauaucauuggccagcgcaucgagaauauuaaaaacgaacacaagucuaccuggcacuacgacgaggauaaucccuauaagacaugggccuaccauggguccuaugaggugaaaccuagcggaucugcguccagcauggugaacggcgucgugagacugcuuacgaagcccugggacguuaucccuauggugacccaaaucgccaugacagacaccacaccguuuggccagcagcgggucuucaaagaaaagguggauacccgcacacccagagcuaaacgggggaccgcccaaauuauggagguuacggcuaaguggcuguggggauuucucucuagaaauaagaaaccucggaucuguacccgcgaagaguucacaagaaaggugcgguccaacgccgcuauuggcgccgucuuuguggacgaaaaucaguggaacagcgcgaaagaggccguugaggaugaacgcuucugggaccuggugcacagagagcgggaacugcauaagcaggggaaaugcgcuaccugcgucuacaauaugaugggaaagcgcgagaagaaacucggcgaauuugggaaggccaaaggcuccagagcuaucugguacauguggcugggagcccgguuccuugaguucgaggcccugggcuuuaugaacgaagaucacugguucagccgcgagaauucucucagcgggguggaaggagagggccugcauaagcuuggguauauucugagagacaucuccaaaauccccggaggcaacauguacgcggaugacacagcugggugggauacccggauuacggaggacgaucuccagaaugaagccaagaucacagacauuauggagccugaacacgcccugcuggcuaccucuaucuuuaaacucacauaucaaaacaaggucgugcgcguucagagacccgccaagagcggcaccgugauggaugucauuucccggcgcgaccagagaggaucuggccagguggggacguacggacugaauaccuucacaaacauggaggugcaacuuauccggcagauggaaagcgagggcaucuuuuccccgucugagcuggaaaccccuaaccucgcuaaaaagguucuggacuggcuugagaaacacggggccgaaagacugaagcgcauggcgauuagcggagaugacuguguggucaaacccaucgaugaccgguucgccacagcucucaccgcccugaaugauaugggcaagauuagaaaggacaucccucagugggagcccuccaaaggguggaacgauuggcagcaagugccuuuuugcagccaucacuuccaucagcugauuaugaaggacggccgcgaaaucguugugcccugucggaaucaggaugagcucgucggaagagcucgcgugucucagggcgccggguggucccugcgggagacagcgugccuuggaaaaagcuaugcccaaauguggcagcugauguacuuucacagacgcgaccuccggcuggcugccaacgcuaucuguucugccgucccgguggauuggguuccuaccuccagaacgacauggagcauucacgcucaucaccaguggaugaccaccgaagacaugcuuuccguguggaaucgcgucuggaucgaggaaaaccccuggauggaggacaagacacaugugucuagcugggaagagguucccuaucugggcaaacgggaggaucaauggugcgggucccucauuggacugaccgccagagcgacaugggccacgaauauccagguggcuauuaaccagguccggagacugaucggcaaugaaaacuaccucgacuacaugaccagcaugaagcgcuucaagaaugagucugauccugaaggggcccugugguga

SEQ ID NO: 18462 - RNA, 9879 nt, Artificial Sequence
  derived and/or modified CDS sequence (opt5) from DENV-1__JX669466__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggcggcagauucagcgcguugagacaugggcucuuagacaccccggcuucaccgugaucgccuuuuuccuggcgcaugccauugggacaucuaucacccagaaaggaaucauuuuuauccuccugaugcuugucaccccuagcauggcuaugcggugcgugggcauugggaaccgcgacuucguugagggacuguccggcgccacauggguggaugucgugcucgaacacgggagcugugugacgaccauggcuaagaauaagcccacacuggacaucgagcugcucaaaaccgaagucacaaacccugccguucugagaaagcuuugcauugaggcgaaaaucucuaauaccacgacagauucccgguguccgacccaaggagaagccacccugguggaggagcaggacgcuaacuuugugugccgcagaacauucgucgaucggggcuggggcaauggguguggacucuuuggcaaggggagccugcuuaccugcgccaaauucaagugcgugacaaagcuggaaggaaaaauuguucaguacgagaaccucaaguauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccgcacaggccuggacuuuaacgagauggugcuucugaccaugaaagagaagucuuggcucguccauaaacagugguuccuggaucuuccucugcccuggacguccggggcuagcacaucccaagaaaccuggaauagacaggaccuccuggugacauuuaagaccgcgcacgccaaaaagcaggaggucgugguucugggaucucaagaaggcgcuaugcacaccgcccucacaggggccacggagauucagaccagcggaacaaccacaaucuucgcuggccaucugaagugccggcuuaaaauggauaagcugacccucaaagggauguccuaugugauguguacgggcagcuucaagcuggaaaaagaggucgccgagacacagcacggaaccauucuggugcagguuaaguacgaaggcaccgacgcgccgugcaagaucccuuuuucuacacaagaugagaaaggggugacccagaacggaagacuuaucacagcuaaucccauugucacggacaaggaaaaaccugugaacaucgagaccgagccccccuucggcgaauccuauauugugguuggggccggagagaaggcccucaaacugagcugguuuaagcgcggcucuagcaucgggaagauguucgaagcuacagcccggggcgcuagacgcauggccauucugggagauaccgcgugggacuuuggcuccaucgggggagucuucacaucugugggcaaacucgugcaucaggucuuugggaccgccuacggagugcuguucagcggcguuuccuggacgaugaagaucgggauuggcauccuucugaccuggcucggacugaauagccggucuacaucccugagcaugaccuguauugcugugggcauggucacacuuuaccucggggugaugguucaggccgaucugggaugcgugaucaacuggaaaggcagagagcugaagugugggucuggaauuuuugucaccaacgaagugcacacauggaccgagcaauauaaauuccaggcugacuccccuaagcgccucagcgccgcgaucggcaaggccugggaggaagggguuugcggcauucgguccgcuacgagacuggagaauaucauguggaaacagaucucuaacgaacuuaaucauauucugcucgagaacgauaugaaguuuacaguggucgugggagacgccaauggcauccuggcucaggggaaaaagaugauucgcccgcaacccauggaacacaaauacagcuggaaguccuggggaaaagccaagaucauuggcgccgacauccagaacaccaccuucaucauugaugggccugacacacccgaguguccugauggacagcgggcuuggaauaucugggagguggaagacuauggcuuuggcgucuucaccacgaacauuuggcugaagcuuagagauucuuacacacagaugugcgaccaccgccucaugagcgcggccaucaaagauuccaaggcuguucaugccgacaugggguauuggauugagagcgaaaaaaaugagaccuggaagcuggcccgggcuucuuucaucgaagugaaaacauguaccuggcccaagucccacacacuguggagcaacggagugcucgagucugagaugaucauuccgaagaucuuuggcgggccuauuucccaacauaauuacagacccggauauuucacccagacggccggcccuuggcaccuggggaaacuugaacuggauuuugaccucugcgagggaaccacagucgugguugaugaacacugcggcaaccggggccccagccugcgcaccacaaccgugacggggaagaucauucaugagugguguugcagaucuuguacacugccuccccuucgguucagaggagaggacggcugcugguacgggauggaaauccgcccggucaaagagaaggaagagaaucucgugcggagcaugguuuccgcgggaagcggcgaaguggauucuuuuucccuggggauccugugugucagcauuaugaucgaggaggugaugagaucccgcuggucuagaaaaaugcucaugaccggaacacuggcuguuuuccuucugcucauuaugggccagcugaccuggaacgaccugauccggcuuugcauuauggugggcgccaaugccagcgaccgcauggggaugggaaccacauaccuggcucucauggccacguuuaagaugagaccuauguucgcggucggccugcucuuucggcgccugaccuccagagaagugcuucugcucacaaucgggcugucucugguggcuagcgucgagcuucccaacucccuggaagagcucggagauggccuggccauggggauuaugaugcucaagcugcuuaccgaauuccaaccccaccagcuguggacaacccuccugucucugacguuuguuaaaacaacccuuagccuggacuaugccuggaagaccacagcuauggugcucuccaucgugagccuguucccucucugucugucuaccacaucccagaaaacgaccuggcuuccgguccugcugggaagcuuuggcugcaagccccucacaauguuccugaucaccgagaacaaaauuuggggccggaagucuuggccucuuaaugaggggaucauggccauuggaaucguguccauucugcucagcucucugcucaagaacgauguuccccuggcuggcccucuuaucgccgggggaaugcugaucgcguguuacgugauuuccggcagcuccgccgaccugagccucgaaaaagcugccgaggucucuugggaacaggaggcugaacauagcggggccucccacaauauccugguggagguucaagaugacggaacaaugaagauuaaagaugaggaacgcgacgauacccuuacgauccugcucaaggccacccugcucgcugugucuggcgucuaucccaugagcauuccugcgacacuguucgugugguacuuuuggcagaaaaagaaacagagauccggcguccuuugggacacccccucuccgccugagguggaacgggccguucuggaugacgggaucuaucgcauccugcagagaggacuccugggccggagccaagugggggucggaguguuccaggauggcguuuuucauacaauguggcacgugaccagaggggcuguccuuauguaccagggaaagcgccuggagcccuccugggccucugugaagaaagaccucauuagcuauggcggcggguggcgguuccagggauccuggaacacaggcgaggaagugcaaguuaucgccgucgagccugggaagaaucccaaaaacgugcagacgaccccgggaacauuuaagaccccugaaggcgaggugggggcuauugcccuggacuucaaacccggaaccagcggcucuccuaucgucaauagagaaggcaagauuguggggcucuacggaaacggcguugugacaacguccgggaccuacgucagcgcgaucgcucaggccaaggccucucaagagggaccccugcccgagauugaagaugagguguuuaaaaagcgcaaucuuacaaucauggaccugcacccuggcuccgggaaaacccggagauaucugccggcuaucguucgcgaagccauuaagcggaaacucagaacacugauccuugcgcccacccgcguggucgcuagcgagauggccgaagcccugaagggcaugccuauucgguaccagacgacagcugugaaguccgagcauaccggaagagagaucguugaucucaugugccacgccaccuucacaaugcggcugcugucucccgugcgcgucccuaacuauaauaugauuaucauggacgaagcucauuuuaccgaucccgccagcaucgcggccagaggcuacauuuccacacggguggggaugggagaggcugccgcuaucuucaugaccgccacgccuccgggcagcguggaagccuuuccccagucuaacgcugucauucaggacgaggaacgcgauaucccugagagauccuggaauagcggguaugacuggauuacagauuuccccggaaaaaccguuugguucgugccuucuaucaagagcggcaacgacaucgcgaauugucuccggaaaaacgggaagagagugauucaacuuucccgcaaaacauuugauaccgaguaccagaagacgaagaacaaugacugggacuaugucgugaccacagauaucucugaaaugggcgccaacuuccgggcugacagaguuauugauccccgccggugccugaaaccggugauccugaaggacggaccugagagagucauucucgccggccccaugcccgugaccguugccagcgcugcccagcgccgggggagaaucggacgcaaucagaacaaagaaggcgaucaauacguguacauggggcagccucugaauaacgacgaggaucacgcgcauuggacagaggcuaagaugcuucuggacaauauuaacacccccgaaggaaucaucccugcccucuuugagccggaaagagagaaauccgccgcuauugauggcgaauaucggcugcgcggggaggccagaaagacauucgucgagcugaugcggcgcggcgaccuccccguguggcuuucuuacaaggucgcgagcgaaggauuucaguauuccgauagacgguggugcuucgacggcgagagaaauaaccaggugcuggaagagaauauggauguugaaaucuggaccaaagagggggagcgcaagaaacugcggccuagauggcucgacgcccgcacguacagcgacccccuggcucuucgggaauuuaaggaguucgccgcuggaagacggucuguguccggcgaucugauucucgaaaucgggaaacugccucaacaccugacacuccgcgcccagaacgcucuugacaaucuggugaugcugcacaacagcgagcagggaggcaaggccuauagacaugcgauggaagagcuccccgauaccauugagacccugaugcuucuggcccucaucgcuguccugacaggcgggguuacccuguuuuuccucuccggaaaaggccuugggaagacaucuaucggacugcugugugugacggccagcuccgcucuccuguggauggccucuguggaaccgcacuggauugccgcuagcaucauucuugaguuuuuccugaugguccuccugaucccugaacccgaccggcagcgcaccccucaagauaaucagcuggcguacgugguuauuggccuccuuuuuaugauccugacaguggccgcuaacgagauggggcugcucgagaccacaaagaaagaccugggaaucggcuaugucgccgccgaaaaccaucagcacgcuaccaugcuugauguggaccugcaccccgccuccgcguggacgcucuacgccgucgcuaccacagugauuaccccuaugaugagacauacaaucgagaauaccacggccaacauuagccugacagcuaucgccaaucaagcggccauucugaugggccucgauaagggguggcccaucucuaaaauggacauuggaguuccgcuucuggcucugggcugcuacucccaggugaacccucucacccugacagccgcuguccuuaugcugguggcccacuaugcuaucaucgggcccggacuccaggccaaggcgacccgggaagcccagaaacgcaccgcugccggcauuaugaagaaucccacaguugaugggaucguggcuauugaccuggauccugucguguacgacgccaaguucgagaaacaacugggacagaucaugcuccuuauucuguguacgagccagauccugcucaugagaaccacaugggcccugugcgaaucuaucacccuugcgacaggcccgcugaccacgcucugggagggcucccccgggaaguucuggaacacaaccauugcugugagcauggccaauaucuuucggggaucuuaucuggcuggcgccgggcuggccuucagccucaugaaaucccuuggaggcgggcgcagaggaaccggcgcucagggcgagacacugggggaaaaguggaaacggcaacugaaccagcucucuaagagcgaguuuaauaccuacaagagauccggaauuauggaaguugaccgcagcgaggccaaagaaggccugaagcggggggagacaacgaaacaugcggucuccagaggaaccgccaagcuucgcugguucguggagcggaaccuggugaaaccugaaggcaaggucaucgaucucggguguggaagaggcggcuggucuuauuacugcgcugggcugaagaaaguuacagaggugaagggauauaccaaaggcgggcccggacacgaagagccuauucccauggccacauacggcuggaaucuggugaagcuccauagcgggaaagacgucuuuuucaugccuccggaaaagugugauacccuucugugcgacaucggagaguccucucccaacccuacgaucgaggaaggccgcacccugcgggugcucaaaaugguugagcccuggcugagaggcaaucaguuuuguauuaagauccuuaacccuuacaugcccagcguggucgaaacacuggagcagaugcaacgcaagcacgggggaaugcucgugcggaauccgcuguccagaaacucuacccacgagauguauuggguuagcugcggcacagggaauauuguguccgcugucaacaugaccagccgcaugcugcucaaccgguucacaauggcccauagaaaaccuaccuacgaacgcgauguggaccugggagcgggcacgagacacguggccgucgagcccgaaguugcuaaucuugauaucauugggcagcggaucgagaacauuaagaaugaacauaaaucuacauggcacuaugacgaggauaaccccuacaagaccugggccuaucacggauccuacgaggugaaaccuagcggcucugcuuccagcauggugaauggcgucgugcgccugcucaccaagcccugggacguuaucccuauggugacacagaucgccaugacggauaccacaccguuugggcaacagagagucuucaaggaaaaaguggacacccggacacccagagcuaagcggggaaccacacagauuauggagguuaccgccaaauggcuguggggcuuucuuucucgcaacaagaaaccuagaaucuguacgcgggaagaguucacccgcaaggugagauccaaugcggccauuggggcugucuuuguggacgaaaaccaguggaauagcgccaaggaggcuguugaggaugaacgguucugggaccuggugcaucgcgagagagaacuccacaaacaaggaaagugcgccacaugcgucuauaacaugaugggcaaacgggagaagaaacugggggaauucggcaaggccaagggaucccgcgcgaucugguacauguggcugggcgcuagauuucucgaguucgaggcccugggguuuaugaaugaagaucauugguucagccgggagaacucucuuagcggaguggaaggcgaggggcugcacaaacucggauacauucugcgcgacaucuccaagauccccggcgggaauauguaugccgaugacaccgcuggcugggauacaagaauuaccgaggacgaucuucagaacgaagccaaaaucacggacauuauggagccugaacaugcucugcucgccacaucuaucuuuaagcugaccuaccagaauaaagucgugcggguucagcgccccgcgaagaacggaacagugauggaugucauuagcagacgggaccaaagaggcuccgggcaggugggaaccuauggccugaacacguucaccaauauggaggugcagcucauccgccagauggaaucugaggggaucuuucugccgagcgagcuugaaacaccuaaccuggccgagcgggcucucgauuggcuggaaaaacacggagccgagagacuuaagcgcauggcuauuuccggcgacgacuguguugugaagcccaucgaugaccgguucgccaccgcgcugacagcccucaaugauauggggaaagucagaaaggacauuccucaaugggaacccucuaaaggcuggaacgauuggcagcaggugccuuuuugcagccaccauuuccaccagcugaucaugaaggacggacgcgagauuguugugcccugucggaaucaagaugagcuggucggcagagcucgcgugucccagggggccggauggagccuccgggaaaccgcuugccugggcaaaucuuacgcccagauguggcaacuuauguauuuucauagacgcgaccugcggcucgcugccaacgcgaucuguuccgccgucccgguggauuggguuccugcuagcagaacaaccuggucuauccacgcccaccaucaguggaugacgacagaggacaugcuguccguguggaaucgggucuggauugaagagaaccccuggauggaagauaagacccacgugagcuccugggaggagguucccuaccuugggaagagagaagaccaguggugcggaucucugaucggccucaccgcccgcgcuacaugggccaccaauauucagguggcgaucaaccaaguccggagacugauugggaaugagaacuaucuggacuacaugacaagcaugaaacgcuucaagaaugaauccgauccugagggcgcucucugguga

SEQ ID NO: 18463 - RNA, 9879 nt, Artificial Sequence
  derived and/or modified CDS sequence (opt5) from DENV-1__JX669467__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagagcaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccccccuuuggcgaguccuauaucguugucggggccggagaaaaggcccugaagcugagcugguucaaaaagggcucuagcauugggaaaauguuugaggcuaccgcccggggcgcuagacgcauggccauccucggagacacagcgugggauuucggcuccauugggggaguguuuaccucugugggcaagcugguccaucagguguucgggacggccuacggaguucuuuuuagcggcguguccuggaccaugaaaaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagaacugaaguguggguccggaaucuucgugacaaacgagguucacaccuggacggaacaauauaaauuucaggcugauagcccuaagcgccucuccgccgcgauuggccgggccugggaggagggggugugcggcaucagaucugcuacacgccuggaaaauauuauguggaaacagaucagcaacgagcuuaaucauauccugcucgaaaacgacauuaaguucaccgucguggugggaaaugccaacggcauccuggcucaggggaaaaagaugauucggccgcaacccauggagcacaaauacuccuggaagucuuggggaaaggccaaaaucauuggcgccgacauccagaauaccacauuuaucauugaugggccugacacccccgaauguccugaugagcagagagcuuggaacaucugggaggucgaagacuauggauucggcauuuuuacgacaaauaucuggcugaagcuucgcgauagcuacacccagaugugcgaccaccggcucauguccgcggccauuaaagauagcaaggcuguucaugccgacaugggcuauuggaucgagucugaaaaaaacgagacauggaagcuggccagagcuuccuucaucgaagugaagaccuguauuuggcccaaaagccacacacuguggucuaauggggugcucgaguccgagaugaucauuccgaagauguacggaggcccuaucagccaacauaacuaucgccccggguacuucacccagacggccggaccuuggcaccugggcaaacuugaacuggauuuugaccucugcgaggggaccacagucgugguugaugaacacugcggaucucggggccccagccugagaaccacaaccgugacgggcaagauuauccaugagugguguugccgguccuguacacugccuccccuucgcuucagaggggaggacggaugcugguacggcauggaaauccggccggucaaagagaaggaagagaaucucgugagaagcaugguuucugcgggguccggagaaguggauagcuuuucccugggcauucugugugucucuaucaugauugaggaggugaugcgcagccggugguccagaaagaugcucaugaccgggacacuggcuguuuuccuucugcucaucaugggacagcugaccuggaacgaccugauucgccuuugcaucauggugggcgccaaugccucugacaaaaugggcauggggaccacauaucuggcucucauggccacguuuaagaugagaccuauguucgcggucggacugcucuuucggcgccugaccagcagagaagugcuucugcucacaauuggccugucccugguggcuucugucgagcuucccaacagccuggaagagcucggggauggacuggccaugggcaucaugaugcucaaacugcuuaccgaauuccaaccccaccagcuguggacaacccuccugucccugacguuuaucaagacaacccuuagccuggacuacgccuggaaaaccacagcuaccguucucucuauugugucccuguucccucucugucugagcacaacgucucagaagaccacauggcuuccggugcugcugggguccuuuggaugcaagccccucaccauguuccugaucacagagaacgagauuuggggccggaaaagcuggccucuuaaugaaggcaucauggccauugggaucgucucuauccugcucuccagccugcucaagaacgaugugccccuggcuggaccucuuauugccggcgggaugcugaucgcguguuauguuauuuccggaagcucugccgaccugagccucgagaaagcugccgaaguguccugggaggaagaggcugagcauucuggcaccagccacaauauccuggucgaagugcaggaugacgggacgaugaagauuaaagaugaggaacgcgacgauacccuuacaauccugcucaaggccacccugcucgccguuuccggaguguaccccaugucuaucccugcuacacuguuugucugguauuucuggcaaaaaaagaagcagagaagcggcgugcuuugggacacccccuccccgccugaggucgagcgggcggugcuggaugacggcauuuaccgcauccugcagagagggcuccugggacggucucagguuggcgugggggucuuccaagauggaguguuucauacaauguggcacguuacgcgcggcgccgugcuuauguaucaggggaaaagacuggaacccagcugggcuuccgucaagaaagaccucauuagcuacggaggcggcuggcgguuccaggggucuuggaacaccggagaggaagugcaggugaucgccguugagccuggcaagaaucccaaaaacguccaaacaaccccggggaccuuuaagacaccugaaggagaggugggcgccauugcucuggacuucaagcccgggacguccggaagcccuaucgugaauagagagggcaaaauugucggccucuacgggaacggagugguuaccacaucuggcaccuauguguccgccaucgcgcaggcuaaggccagccaggaagggccccugcccgagaucgaagaugaggucuuuaaaaagcgcaaucuuacaauuauggaccugcacccuggauccggcaaaacccggagauaccugccggccaucgugcgcgaagcuauuaagcggaagcucagaacgcugauccuugcccccacacgcguuguggcgucugagauggcugaggcccugaaagggaugccuauucgguaucaaaccaccgccgucaagagcgaacauacaggcagagagaucguggaucucaugugccacgcuaccuucacaaugcgccugcugucccccguucgggugccuaacuacaauaugaucauuauggacgaagcccauuuuaccgaucccgcuagcaucgccgcgagaggauauauuucuacgcgggucggcaugggggaggccgcugccaucuucaugacagcuaccccuccgggauccguggaagccuuuccccagagcaacgccgugauucaggacgaggagcgcgauaucccugaaagaucuuggaauagcggcuacgacuggaucacagauuuccccgggaaaaccgucugguuuguuccuuccauuaagucuggaaacgacaucgcuaauugucuccggaaaaacggcaagcgcgugauucagcuuagcagaaagacguucgauaccgaguaucaaaaaacaaagaacaaugacugggacuacguggucaccacagauaucuccgaaaugggggcgaacuuccgggccgacagagugauugauccccgccggugccugaaaccgguuauccugaaggacggcccugagagagugauucucgcuggacccaugcccgucaccguggccucugccgcucagcgccggggcagaaucgggcgcaaucagaacaaagagggagaucaguacguuuauaugggccaaccucugaauaacgacgaagaucacgcccauuggacagaggcgaagaugcuucuggacaauaucaacacccccgaagggauuaucccugcucucuuugagccggaacgggagaagagcgccgccauugauggagaguacagacugcgcggcgaagcuagaaaaacguucguggagcugaugcggcgcggggaccuccccgucuggcuuuccuauaagguggccagcgaaggcuuucaguacucugauagacgguggugcuucgacggagagcgcaauaaccagguccuggaagagaauauggauguggagaucuggacaaaagaaggcgagagaaagaaacugcggccuagauggcucgacgcgcgcaccuauuccgacccccuggcccuucgggaauuuaaggaguucgcugccgggagacgcagcguuuccggagaucugauucucgaaaucggcaaacugccucagcaccugacccuccgggcucaaaacgcccuugacaaucuggugaugcugcacaacucugagcaggggggaaaggcuuacagacaugccauggaggaacuccccgauacaaucgagacccugaugcuucuggcgcucauugccgugcugacaggcggcgucacgcuguuuuuccucagcgggaagggacuuggcaaaaccuccaucgggcugcuguguguuacagcuucuagcgcccuccuguggauggcuuccguggaaccgcacuggauugccgccagcaucauucuugaguuuuuccugauggugcuccugaucccugagcccgaccggcagcgcaccccucaggauaaucaacuggcuuaugucgugaucggacuccuuuuuaugauucugacaguugcggccaacgaaaugggccugcucgagaccacgaagaaagaccuggggaucggacauguggcugccgaaaaccaccagcacgccaccaugcuugaugucgaccugcaucccgcuucugccuggacacucuacgcgguggccaccacagucauuaccccuaugaugagacacacgaucgagaauacaaccgcuaacauuucccugacagccaucgcuaaucaggccgcgauucugaugggccucgauaagggcuggcccaucagcaaaauggaccuuggggugccgcugcuggcccucggaugcuacucucaaguuaacccucugacccuuaccgcugccgugcugaugcucgucgcucauuaugccaucauuggccccgggcugcaggcuaaggccacacgggaagcgcagaagcgcacggccgcuggaaucaugaaaaaucccaccguggauggcauuguugccaucgaccuggauccuguggucuacgacgcuaaguucgagaaacagcucgggcaaauuaugcuucugauccuguguacaucccagauccuccugaugagaaccacaugggcccuuugcgagagcauuacccuggccacgggaccgcucacaacccugugggaaggcucucccggcaaguuuuggaacaccacaaucgcggugagcauggcuaauauuuuccggggguccuaucuggccggagcuggccucgccuucucucuuaugaaaagccuggggggaggccgcagagggaccggagcccagggcgagacacugggcgaaaaguggaagcggcagcucaaccaacuguccaaaagcgaguuuaauacguacaagcgcuccgggaucauggaaguggacagaucugaggcuaaagagggacuuaagcggggcgaaaccacaaaacacgccguuagcagagggaccgcgaagcugcgcugguucgucgagcggaaccucgugaagccugaaggaaaagugauugaucugggcugugggagaggaggcugguccuauuacugcgccggccugaagaaagucacagagguuaagggguauaccaaaggaggccccgggcaugaagagccuauccccauggcuacguacggauggaaucucgugaagcuucacucuggcaaagacguguuuuucaugccuccggagaagugugauacccugcugugcgacaucggggaaagcucccccaacccuacaauugaggaaggacgcacccuccggguccugaagaugguggagcccuggcuuagaggcaaucaguuuuguaucaaaauucugaacccuuacaugcccucuguuguggagacacucgaacagaugcagcgcaagcacggcgggaugcugguccggaauccgcugagcagaaacuccacccaugagauguauugggugagcugcggaacaggcaauaucguuucugccgugaacaugaccucccgcaugcuccugaaccgguucacgauggcucacagaaaaccuacauacgaacgcgaugucgaccuuggggccggaacccggcauguggcgguggagcccgaagucgccaaucuggauauuaucggccaaagaauugagaacaucaagaaugagcacaaaagcaccuggcacuaugacgaagauaaccccuacaagacaugggcuuaucaugggucuuacgagguuaagccuuccggaagcgccucuuccauggugaauggcgugguccgccuccugacgaaacccugggacgugaucccuaugguuacccagauugcuaugacagauaccacaccguuuggccagcaaagaguguucaaggaaaaagucgacacccggacaccccgcgccaagagagggaccgcucagaucauggaggugacggccaaauggcuuuggggauuucugagccggaacaagaagccuagaauuuguacccgggaagaguucacacgcaaaguuagauccaaugcggccaucggcgcuguguuugucgacgagaaccaguggaauagcgccaaggaagcuguggaggaugaacgguucugggaccucguucaccgcgagagagaacugcauaaacaggggaagugcgccaccugcguguauaacaugaugggaaaacgggagaagaagcugggcgaguuugggaaagccaagggcucucgcgcgauuugguacauguggcucggagcuagauuccuggaauucgaggcccuuggcuuuaugaaugaagaucacugguucagccgggagaacucccugucuggggucgagggagaaggccuccauaaacugggguacauccuucgcgacaucagcaagauucccggaggcaauauguaugccgaugacacagcugggugggauaccagaaucacggaggacgaucugcaaaacgaagccaaaauuacagacaucauggagccugaacacgcucuccuggccaccuccauuuuuaagcugacauaccagaauaaagugguccgggugcagcgccccgcgaagaacggcaccguuauggaugugaucucuagacgggaccagcgcggaagcggccaagucgggacguauggacucaacaccuucacaaauauggaggugcagcugaucagacagauggaguccgaaggcauuuuuuucccgucugagcuugaaagcccuaaccuggccgagcgggugcucgauuggcuggaaaagcacggggcugagagacuuaaacgcauggccaucuccggagacgacuguguugugaagcccauugaugaccgguuugcuaccgcccugaucgcgcucaaugauaugggcaaagucagaaaggacauuccucagugggagcccagcaaaggguggaacgauuggcaacaggugccuuucugcucucaucacuuucaucagcugaucaugaaggacggccgcgaaaucguugugcccugucggaaucaggaugagcuggucggaagagcccgcgugucccaaggcgcuggguggagccuccgggaaacagccugccugggaaagucuuacgcucagauguggcagcuuauguauuuccacagacgcgaccugcggcucgccgcuaacgccauuuguuccgcggucccgguggauuggguuccuaccagcagaacaaccugguccauccacgcccaucaccaauggaugacgacagaggacaugcugucuguguggaaucgcgucuggauugaagagaaccccuggauggaggauaaaacccaugugagcuccugggaagagguucccuaccuuggcaagcgggaagaccaguggugcgggagccugaucggacucaccgcuagagccacaugggccaccaauauucagguggcuaucaaccagguccggagacugauuggcaaugagaacuaucuggacuacaugacaucuaugaaacgcuuuaagaaugaguccgauccugaaggggcccucugguga

SEQ ID NO: 18464 - RNA, 9879 nt, Artificial Sequence
  derived and/or modified CDS sequence (opt5) from DENV-1__HM469967__SS-prME
agcgugaccaugcugcucaugcugaugcccaccgcucuugcuuuccaccugacgaccagaggcggggagccucauaugaucgucuccaagcaggaacggggaaaaucucuccuguuuaagaccagcgcuggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaaguucacaguuguggucggagauguggcuggcauucucgcccaggggaaaaagaugauccggccgcaacccauggaguacaaauauucuuggaaaagcuggggaaaggccaagauuaucggcgcugacgugcagaauaccaccuuuaucauugaugggccuaacacacccgaauguccugacgaucagagagcguggaauaucugggaggucgaggacuacggauucggcauuuuuaccacgaacaucuggcugaagcugcgcgauuccuauacacagguuugcgaccaccggcuuaugagcgccgcuauuaaagauucuaaggccgugcacgccgacaugggcuacuggaucgaauccgagaaaaaugaaaccuggaagcucgcuagagccagcuucaucgaggugaagacauguauuuggcccaaaucucauacccugugguccaacgggguccuggaaagcgagaugaucauuccgaagaucuauggaggcccuauuucucaacacaauuaccgccccggguacuucacacagaccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggaaaaugcucaugacagggacccuggccguuuucuuucuucugauuaugggacagcucacauggaacgaucugaucagacugugcauuauggugggcgccaaugcuucugaccgcaugggcauggggaccaccuaccuugcccugauggcgacauucaagaugagaccuauguuugcugucggacuccuguuccggcgccucacgagcagagaggugcugcuucugaccaucggccucucccugguggccucugucgaacugcccaacagccuugaggaacugggggauggacucgccaugggcaucaugauucugaaacuccugacagacuuucaaucccaucagcuuugggcuacccugcucagccugacauucaucaagaccacguuuucucugcacuaugccuggaaaacaauggcuaugguucuuuccauugugagccuguucccccucugucugucuaccaccucccagaagacaaccuggcucccugugcugcuugggagccugggaugcaagccgcugacaauguuucucaucgccgagaauaaaauuuggggccggaagucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgcgacgauacccugacaauccuucugaaagccacccuccuggcugugucuggagucuauccucucagcauucccgccacacuguucgugugguacuucuggcaaaagaagaaacagagauccggcguccuuugggacaccccuucucccccgaagguggaacgggccguucuggaugacggcaucuaucgcauuaugcagagagggcugcucggacggagccaggugggcgucgggguguuucaagagaacguuuuccauacgauguggcacgugacccgcggagcuguccugauguaccagggcaaaagacuugaaccuuccugggccagcgugaagaaagaccugaucucuuacgggggaggcuggcggcuccagggcuccuggaauacaggggaggaggugcagguuauugcggucgaacccggaaagaacccuaagaaugugcaaaccgcucccggcacauuuaaaaccccggagggggaaaucggagccauugcccuggauuucaagccuggcacaagcgggucucccaucgugaacagagagggaaaaaucgucggccucuauggcaauggggugguuacgaccuccggaacauacgugagcgcuauugcccaggcgaaggcuucccaggaaggcccucugcccgagaucgaggacgaagucuuucgcaaacggaaccuuaccauuauggaucugcaccccgggucuggaaagaccagacgcuaucugccugccaucgugcgggaggccauuaagagaaaacuccgcacacugauccuugcuccgacgcggguuguggccagcgaaauggcugaggcccugaagggcaugcccaucagauaccaaaccacagcggucaaauccgaacauaccgggaaggagauuguggaccucaugugccacgccacauucaccaugcgccugcugagcccuguucgggugcccaauuauaacaugaucauuauggaugaggcucauuuuacggacccuucuuccaucgccgcuagaggcuacauuagcacacgggucggaaugggcgaagccgccgcuaucuucaugaccgcgacacccccugggucuguggaggccuuuccgcagagcaaugcugugauccaggaugaagaacgcgacauucccgaaagauccuggaacucuggauaugaguggaucacagauuucccuggcaaaaccgucugguuuguucccagcauuaaggccgggaaugacaucgccaacugucuccggaagaauggaaaacgcgugauucagcuuuccagaaagacauucgauaccgaguaccagaagacgaagaacucugacugggacuacguggucacaaccgauaucagcgaaaugggcgcuaacuuccgggccgacagagugauugauccucgccggugccugaaacccguuauccugaaggacgggccggagagagugauccucgcgggcccuaugcccgucacaguggcuuccgccgcccagcgccggggaagaguuggccgcaaucacaacaaggaaggggaucaguauauuuacaugggacagccccugaauaacgacgaggaucaugcucacuggaccgaggccaaaaugcuucuggacaauaucaacacgccugaaggcauuauccccgcgcucuuugagccugaacgggaaaagagcgccgcuauugauggggaauauagacugcgcggagaggccagaaaaaccuucguggagcugaugcggcgcggcgaccucccggucuggcuuucuuacaagguggcuuccgaaggguuucaauauagcgauagacgguggugcuucgacggcgagcgcaauaaccagguccuggaagagaauauggauguggaaaucuggacaaaagagggagagagaaagaaacugcggcccagauggcucgacgcccgcaccuacuccgacccucuggcccuucgggaauuuaaggaguucgccgcgggcagacgcucuguuagcggggaucugauccucgaaauuggaaagcugccccagcaccugacacagcgggcccaaaacgcucucgacaaucuugugaugcugcauaacuccgagcagggcgggagagccuaucggcacgcuauggaggaacugccugauaccaucgagacacucaugcugcuugcccugauugccgugcucaccggaggcgucacgcuguuuuuccugucuggccgcgggcucggaaaaacaagcaucggccuucuguguguuauggcuuccagcgugcugcucuggauggcgucuguggaaccccauuggauugccgcuuccaucauccuggaguuuuuccuuaugguccugcucauuccggaaccugacagacagcggacaccccaggauaaucaacuggccuacgugguuaucgggcugcucuuuaugauucuuaccguggccgcuaacgagaugggacugcuggagacaaccaagaaagaccucggcaucgggcacgucgccguggaaaaucaccaucacgcggccaugcuggaugucgaccuucauccugcuagcgccuggacacuguacgcuguggccacgaccauuaucacacccaugaugcgccacaccauugagaacacaaccgcgaacaucucucucacggccaucgcuaaucaggccgcuauucugaugggacuggauaagggcuggccuaucuccaaaauggacauuggcguuccccuccuugcccuggggugcuauagccaggugaacccgcugacccucacagcugccguccugaugcuuguggcgcauuacgccaucauuggaccuggccugcaagcuaaggccaccagagaagcucagaagcggacagccgccgggaucaugaaaaaucccaccguugauggaaucguggcgauugaccucgaucccgucguguaugacgcuaaguucgagaaacagcugggccagaucaugcugcucauucuuuguacgucucaaauccugcugaugcgcacaaccugggcccucugcgaaagcauuacacuggcuaccgggccucuuaccacacuguggaagggauccccgggcaaauuuuggaacacgaccaucgccgugucuauggccaauaucuucagaggcagcuaccucgcuggggccggacuggcguucucccugaugaaaagccucggcgggggacggcgcggcacaggggcccagggagagacccuuggcgagaaguggaaaagacagcugaaccagcuguccaagucugaauuuaauacauauaaacggagcggcauuauggagguugacagauccgaagcuaaggaggggcucaaacgcggagaaaccacgaagcacgccgucucucggggcacagcuaagcugaaaugguucguggagagaaaccuugugaagcccgaggggaaagucaucgaucugggauguggccgcgggggauggagcuacuauugcgccggccucaagaaaguuaccgaagugaagggcuacaccaaagggggaccuggccacgaggaacccauuccuauggcgacauacggguggaaucuggugaagcugcauuccggaaaggacgucuuuuucauucccccugagaaaugugauacccuccuuugcgacauuggcgaaucuagcccgaaccccacaaucgaggaggggcggacgcugagagugcugaagaugguugaaccuuggcuccgcaaaaaucaauuuuguauuaagauccugaaccccuauaugccuuccguggucgagacccuugaacagaugcagcggaaacacggaggcaugcuggugagaaauccccucagccgcaacucuacacaugagauguacuggguuuccugcggcaccgggaauaucgugagcgccgucaacaugacaucucggaugcugcugaauagauucaccauggcucaccgcaagccgacguaugagcgggauguggaccucggagccggcaccagacacguggcugucgaaccugagguugccaaccuggauauuaucgggcagcgcauugaaaacaucaagcaugagcacaaauccacauggcauuacgacgaagauaaucccuauaagaccugggcuuaccacggaagcuaugaggugaaacccucuggcuccgccagcuccauggugaacggggucgugaaacuucugacaaaaccuugggacguuauucccauggugacccaaaucgcgaugacagauaccacgccuuuuggacagcagagagucuucaaggagaagguggacacacggaccccgaaagccaagcgcggcaccgcucaaaucauggaaguuacagccagauggcucuggggcuuucugagccggaauaaaaagcccagaauuuguacgcgggaggaguucacccgcaaagugagaucuaacgcugccaucggggccgucuuuguggacgagaaucaguggaacagcgcgaaggaagcuguugaggaugagcgguucugggaccuugugcaucgcgaaagagagcugcacaagcagggaaaaugcgccacaugcgucuacaauaugaugggcaagcgggagaagaagcucggggaguuuggaaaagccaagggcucccgcgcuauuugguacauguggcugggggccagauuccuggaguucgaggcucucggcuuuaugaacgaggaucacugguucucucgggaaaauagccuguccggaguggagggcgaagggcuucauaaacugggauauauccuccgcgacauuucuaagaucccuggcgggaacauguacgccgaugacaccgcgggaugggauacaagaaucaccgaggacgaucugcagaaugaggccaagauuacagacaucauggaacccgagcacgcccuucuggccaaaagcauuuuuaagcucaccuaucaaaacaaagucgugcggguucagcgcccugcuaagaauggcacggugauggaugucaucuccagacgggaccagcgcgggucuggccaggugggaaccuacggccugaacacauucaccaauauggaagcccaacugauuagacagauggagagcgaagggaucuuuucccccagcgagcucgagacaccgaaccuggcggaacgggugcuugauuggcuggagaaauauggaguugaaagacucaagcgcauggccaucucuggcgacgacuguguggucaagccuauugaugaccgguucgcuaccgcccugacggcucuuaacgauauggggaaagugagaaaggacaucccccagugggagccuuccaaaggauggaaugauuggcagaagguucccuuuugcagccaucacuuccaccaacugauuaugaaagacggccgcgaaaucguggucccuugucggaaccaggaugagcucguggggagagcccgcgucucucagggcgcuggauggucccugcgggagacagccugccugggcaagagcuacgcgcagauguggcaacucauguauuuucauagacgcgaccugcggcuugccgcuaaugccauuuguuccgccgugcccguugauugggugccgaccucuagaacaaccuggagcauccacgcucaucaccaguggaugacgaccgaagacaugcuguccgucuggaaccgcguguggauugaggaaaauccuuggauggaggauaagacacauaucagcucuugggaagacguucccuaccucgggaaacgggaggaccaguggugcggaucccugaucggccuuaccgccagagcgacaugggcuaccaacauucaaguggccaucaaucagguccggagacugauugggaacgagaauuaccucgauuauaugacaagcaugaagcgcuucaaaaacgaaucugaccccgagggagcccugugguga

SEQ ID NO: 18465 - RNA, 9879 nt, Artificial Sequence
  derived and/or modified CDS sequence (opt5) from DENV-1__JX669468__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagagcaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccccccuuuggcgaguccuauaucguugucggggccggagaaaaggcccugaagcugagcugguucaaaaagggcucuagcauugggaaaauguuugaggcuaccgcccggggcgcuagacgcauggccauccucggagacacagcgugggauuucggcuccauugggggaguguuuaccucugugggcaagcugguccaucagguguucgggacggccuacggaguucuuuuuagcggcguguccuggaccaugaaaaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagaacugaagugugggaacggaaucuucgugacaaaugagguucacaccuggacggaacaauauaaauuucaggcugauuccccuaagcgccucagcgccgcgauuggccgggccugggaggagggggugugcggcaucagauccgcuacacgccuggaaaacauuauguggaaacagaucucuaaugagcuuaaccauauccugcucgaaaaugacauuaaguucaccgucguggugggaaacgccaauggcauccuggcucaggggaaaaagaugauucggccgcaacccauggagcacaaauacagcuggaaguccuggggaaaggccaaaaucauuggcgccgacauccagaacaccacauuuaucauugaugggccugacacccccgaauguccugaugagcagagagcuuggaauaucugggaggucgaagacuauggauucggcauuuuuacgacaaacaucuggcugaagcuucgcgauucuuacacccagaugugcgaccaccggcucaugagcgcggccauuaaagauuccaaggcuguucaugccgacaugggcuauuggaucgagagcgaaaaaaaugagacauggaagcuggccagagcuucuuucaucgaagugaagaccuguauuuggcccaaaucccacacacuguggagcaacggggugcucgagucugagaugaucauuccgaagauguacggaggcccuaucucccaacauaauuaucgccccggguacuucacccagacggccggaccuuggcaccugggcaaacuugaacuggauuuugaccucugcgaggggaccacagucgugguugaugaacacugcggaagccggggccccucucugagaaccacaaccgugacgggcaagauuauccaugagugguguugccggagcuguacacugccuccccuucgcuucagaggggaggacggaugcugguacggcauggaaauccggccggucaaagagaaggaagagaaccucgugagauccaugguuagcgcggggucuggagaaguggauuccuuuagccugggcauucugugugucuccaucaugauugaggaggugaugcgcucucgguggagcagaaagaugcucaugaccgggacacuggcuguuuuccuucugcucaucaugggacagcugaccuggaaugaccugauucgccuuugcaucauggugggcgccaacgccuccgacaaaaugggcauggggaccacauaucuggcucucauggccacguuuaagaugagaccuauguucgcggucggacugcucuuucggcgccugaccucuagagaagugcuucugcucacaauuggccugagccugguggcuuccgucgagcuucccaacucucuggaagagcucggggauggacuggccaugggcaucaugaugcucaaacugcuuaccgaauuccaaccccaccagcuguggacaacccuccugagccugacguuuaucaagacaacccuuucccuggacuacgccuggaaaaccacagcuaccguucucagcauugugucucuguucccucucugucuguccacaacgagccagaagaccacauggcuuccggugcugcuggggucuuuuggaugcaagccccucaccauguuccugaucacagagaaugagauuuggggccggaaauccuggccucuuaacgaaggcaucauggccauugggaucgucagcauccugcucucuucccugcucaagaaugaugugccccuggcuggaccucuuauugccggcgggaugcugaucgcguguuauguuauuagcggauccagcgccgaccugucucucgagaaagcugccgaagugagcugggaggaagaggcugagcauuccggcaccucucacaacauccuggucgaagugcaggaugacgggacgaugaagauuaaagaugaggaacgcgacgauacccuuacaauccugcucaaggccacccugcucgccguuagcggaguguaccccauguccaucccugcuacacuguuugucugguauuucuggcaaaaaaagaagcagagaucuggcgugcuuugggacacccccagcccgccugaggucgagcgggcggugcuggaugacggcauuuaccgcauccugcagagagggcuccugggacggucccagguuggcgugggggucuuccaagauggaguguuucauacaauguggcacguuacgcgcggcgccgugcuuauguaucaggggaaaagacuggaacccucuugggcuagcgucaagaaagaccucauuuccuacggaggcggcuggcgguuccaggggagcuggaauaccggagaggaagugcaggugaucgccguugagccuggcaagaaccccaaaaauguccaaacaaccccggggaccuuuaagacaccugaaggagaggugggcgccauugcucuggacuucaagcccgggacgucuggauccccuaucgugaacagagagggcaaaauugucggccucuacgggaauggagugguuaccacaagcggcaccuaugugucugccaucgcgcaggcuaaggccucccaggaagggccccugcccgagaucgaagaugaggucuuuaaaaagcgcaaccuuacaauuauggaccugcacccuggaagcggcaaaacccggagauaccugccggccaucgugcgcgaagcuauuaagcggaagcucagaacgcugauccuugcccccacacgcguuguggcguccgagauggcugaggcccugaaagggaugccuauucgguaucaaaccaccgccgucaagucugaacauacaggcagagagaucguggaucucaugugccacgcuaccuucacaaugcgccugcugagccccguucgggugccuaauuacaacaugaucauuauggacgaagcccauuuuaccgaucccgcuuccaucgccgcgagaggauauauuagcacgcgggucggcaugggggaggccgcugccaucuucaugacagcuaccccuccgggaucuguggaagccuuuccccaguccaaugccgugauucaggacgaggagcgcgauaucccugaaagaagcuggaacucuggcuacgacuggaucacagauuuccccgggaaaaccgucugguuuguuccuagcauuaaguccggaaaugacaucgcuaacugucuccggaaaaacggcaagcgcgugauucagcuuucuagaaagacguucgauaccgaguaucaaaaaacaaagaauaacgacugggacuacguggucaccacagauaucagcgaaaugggggcgaauuuccgggccgacagagugauugauccccgccggugccugaaaccgguuauccugaaggacggcccugagagagugauucucgcuggacccaugcccgucaccguggccuccgccgcucagcgccggggcagaaucgggcgcaaccagaauaaagagggagaucaguacguuuauaugggccaaccucugaacaaugacgaagaucacgcccauuggacagaggcgaagaugcuucuggacaacaucaauacccccgaagggauuaucccugcucucuuugagccggaacgggagaagucugccgccauugauggagaguacagacugcgcggcgaagcuagaaaaacguucguggagcugaugcggcgcggggaccuccccgucuggcuuagcuauaagguggccuccgaaggcuuucaguacagcgauagacgguggugcuucgacggagagcgcaacaaucagguccuggaagagaacauggauguggagaucuggacaaaagaaggcgagagaaagaaacugcggccuagauggcucgacgcgcgcaccuauucugacccccuggcccuucgggaauuuaaggaguucgcugccgggagacgcuccguuagcggagaucugauucucgaaaucggcaaacugccucagcaccugacccuccgggcucaaaaugcccuugacaaccuggugaugcugcacaauuccgagcaggggggaaaggcuuacagacaugccauggaggaacuccccgauacaaucgagacccugaugcuucuggcgcucauugccgugcugacaggcggcgucacgcuguuuuuccucucugggaagggacuuggcaaaaccagcaucgggcugcuguguguuacagcuuccucugcccuccuguggauggcuagcguggaaccgcacuggauugccgccuccaucauucuugaguuuuuccugauggugcuccugaucccugagcccgaccggcagcgcaccccucaggauaaccaacuggcuuaugucgugaucggacuccuuuuuaugauucugacaguugcggccaacgaaaugggccugcucgagaccacgaagaaagaccuggggaucggacauguggcugccgaaaaucaccagcacgccaccaugcuugaugucgaccugcaucccgcuagcgccuggacacucuacgcgguggccaccacagucauuaccccuaugaugagacacacgaucgagaacacaaccgcuaauauuucucugacagccaucgcuaaccaggccgcgauucugaugggccucgauaagggcuggcccaucuccaaaauggaccuuggggugccgcugcuggcccucggaugcuacagccaaguuaauccucugacccuuaccgcugccgugcugaugcucgucgcucauuaugccaucauuggccccgggcugcaggcuaaggccacacgggaagcgcagaagcgcacggccgcuggaaucaugaaaaaccccaccguggauggcauuguugccaucgaccuggauccuguggucuacgacgcuaaguucgagaaacagcucgggcaaauuaugcuucugauccuguguacaucucagauccuccugaugagaaccacaugggcccuuugcgaguccauuacccuggccacgggaccgcucacaacccugugggaaggcagccccggcaaguuuuggaauaccacaaucgcggugucuauggcuaacauuuuccgggggagcuaucuggccggagcuggccucgccuucucccuuaugaaaucucuggggggaggccgcagagggaccggagcccagggcgagacacugggcgaaaaguggaagcggcagcucaaucaacugagcaaauccgaguuuaacacguacaagcgcagcgggaucauggaaguggacagauccgaggcuaaagagggacuuaagcggggcgaaaccacaaaacacgccguuucuagagggaccgcgaagcugcgcugguucgucgagcggaaucucgugaagccugaaggaaaagugauugaucugggcugugggagaggaggcuggagcuauuacugcgccggccugaagaaagucacagagguuaagggguauaccaaaggaggccccgggcaugaagagccuauccccauggcuacguacggauggaaccucgugaagcuucacuccggcaaagacguguuuuucaugccuccggagaagugugauacccugcugugcgacaucggggaaucuagccccaauccuacaauugaggaaggacgcacccuccggguccugaagaugguggagcccuggcuuagaggcaaccaguuuuguaucaaaauucugaauccuuacaugcccuccguuguggagacacucgaacagaugcagcgcaagcacggcgggaugcugguccggaacccgcugucuagaaauagcacccaugagauguauuggguguccugcggaacaggcaacaucguuagcgccgugaacaugaccucucgcaugcuccugaaucgguucacgauggcucacagaaaaccuacauacgaacgcgaugucgaccuuggggccggaacccggcauguggcgguggagcccgaagucgccaaccuggauauuaucggccaaagaauugagaauaucaagaacgagcacaaauccaccuggcacuaugacgaagauaaucccuacaagacaugggcuuaucaugggagcuacgagguuaagccuucuggauccgccagcucuauggugaacggcgugguccgccuccugacgaaacccugggacgugaucccuaugguuacccagauugcuaugacagauaccacaccguuuggccagcaaagaguguucaaggaaaaagucgacacccggacaccccgcgccaagagagggaccgcucagaucauggaggugacggccaaauggcuuuggggauuucugucccggaauaagaagccuagaauuuguacccgggaagaguucacacgcaaaguuagaagcaacgcggccaucggcgcuguguuugucgacgagaaucaguggaacuccgccaaggaagcuguggaggaugaacgguucugggaccucguucaccgcgagagagaacugcauaaacaggggaagugcgccaccugcguguauaauaugaugggaaaacgggagaagaagcugggcgaguuugggaaagccaagggcagccgcgcgauuugguacauguggcucggagcuagauuccuggaauucgaggcccuuggcuuuaugaacgaagaucacugguucucucgggagaauagccuguccggggucgagggagaaggccuccauaaacugggguacauccuucgcgacaucucuaagauucccggaggcaacauguaugccgaugacacagcugggugggauaccagaaucacggaggacgaucugcaaaaugaagccaaaauuacagacaucauggagccugaacacgcucuccuggccaccagcauuuuuaagcugacauaccagaacaaagugguccgggugcagcgccccgcgaagaacggcaccguuauggaugugaucuccagacgggaccagcgcggaucuggccaagucgggacguauggacucaauaccuucacaaacauggaggugcagcugaucagacagauggagagcgaaggcauuuuuuucccguccgagcuugaaucuccuaaucuggccgagcgggugcucgauuggcuggaaaagcacggggcugagagacuuaaacgcauggccaucagcggagacgacuguguugugaagcccauugaugaccgguuugcuaccgcccugaucgcgcucaacgauaugggcaaagucagaaaggacauuccucagugggagcccuccaaaggguggaaugauuggcaacaggugccuuucugcagccaucacuuucaucagcugaucaugaaggacggccgcgaaaucguugugcccugucggaaccaggaugagcuggucggaagagcccgcgugucucaaggcgcuggguggucccuccgggaaacagccugccugggaaagagcuacgcucagauguggcagcuuauguauuuccacagacgcgaccugcggcucgccgcuaaugccauuuguucugcggucccgguggauuggguuccuaccuccagaacaaccuggagcauccacgcccaucaccaauggaugacgacagaggacaugcuguccguguggaaccgcgucuggauugaagagaaucccuggauggaggauaaaacccaugugucuagcugggaagagguucccuaccuuggcaagcgggaagaccaguggugcgggucccugaucggacucaccgcuagagccacaugggccaccaacauucagguggcuaucaaucagguccggagacugauuggcaacgagaauuaucuggacuacaugacaagcaugaaacgcuuuaagaacgagucugauccugaaggggcccucugguga

SEQ ID NO: 18466 - RNA, 9879 nt, Artificial Sequence
  derived and/or modified CDS sequence (opt5) from DENV-1__JX669469__SS-prME
agcgugaccaugcugcucaugcugcuucccaccgcucuggcuuuccaccucacgacccggggaggggaaccucauaugaucguguccaagcaggaacggggaaaaucucugcuuuuuaagacaagcgcuggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauuaaagcgaagaucucuaauaccacgacagacucccgcuguccgacccaaggagaagccacccucguggaggaacaggaugcuaacuucgugugcagacggacauuugucgaccgcggcuggggcaauggguguggacuguucggcaaggggagccuucugaccugcgccaaauuuaagugcgugacaaaacucgagggaaagauuguucaguacgagaaccugaaauauucugugaucgucacggugcacaccggcgaucagcaucaaguugggaaugaaacaaccgagcacggaacaaucgcuaccauuacgccccaggccccuaccuccgaaauccagcugacagacuacggcgcccucacccuggacuguagccccagaacaggccuugauuucaacgagauggugcugcucaccaugaaggaaaaaucuuggcugguccauaagcagugguuucuugaccugccucuccccuggacguccggggcuagcacaucccaagagaccuggaaucggcaggaucugcuggugacauucaagaccgcgcacgccaaaaagcaggaggucgugguucucggaucucaagaaggcgcuaugcacaccgcccugacaggggccacggagauucagaccagcggaacaaccacaaucuuugcuggccaucuuaaaugccgccugaagauggacaaacucacccugaaggggacguccuaugugauguguacaggcagcuucaagcuggaaaaagaggucgccgaaacccagcacggaaccgugcuuguucaggugaaguacgagggcacagaugcgccgugcaaaauuccuuucucuacccaagacgagaagggggucacacagaacggaagacucaucacggcuaaucccaucgugaccgauaaagaaaagccugugaacauugagacagaaccgcccuuuggcgaguccuauaucguugucggggccggagagaaggcccugaaacugagcugguucaagaaaggcucuagcauugggaagauguuugaagcuaccgcccggggcgcuagacgcauggccauccucggagacacagcgugggauuucggcuccauugggggaguguuuaccucugugggcaaacugguccaucagguguucgggacggccuacggaguucuuuuuagcggcguguccuggaccaugaagaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagagcugaaauguggguccggaaucuucgugacaaacgaaguucacaccuggacggagcaauauaaguuucaggcugauagcccuaaacgccucuccgccgcgauuggccgggccugggaagagggggugugcggcaucagaucugcuacacgccuggagaauauuauguggaagcagaucagcaacgaacuuaaucauauccugcucgagaacgacauuaaauucaccgucguggugggaaaugccaacggcauccuggcucaggggaagaaaaugauucggccgcaacccauggaacacaaguacuccuggaagucuuggggaaaagccaagaucauuggcgccgacauccagaauaccacauuuaucauugaugggccugacacccccgaguguccugaugaacagagagcuuggaacaucugggaggucgaggacuauggauucggcauuuuuacgacaaauaucuggcugaaacuucgcgauagcuacacccagaugugcgaccaccggcucauguccgcggccauuaaggauagcaaagcuguucaugccgacaugggcuauuggaucgaaucugagaagaacgaaacauggaagcuggccagagcuuccuucaucgaggugaaaaccuguauuuggcccaagagccacacacuguggucuaauggggugcucgaauccgagaugaucauuccgaaaauguacggaggcccuaucagccaacauaacuaucgccccggguacuucacccagacggccggaccuuggcaccugggcaaacuugagcuggauuuugaccucugcgaagggaccacagucgugguugaugagcacugcggaucucggggccccagccugagaaccacaaccgugacgggcaaaauuauccaugaaugguguugccgguccuguacacugccuccccuucgcuucagaggggaggacggaugcugguacggcauggagauccggccggucaaggaaaaggaggaaaaucucgugagaagcaugguuucugcgggguccggagagguggauagcuuuucccugggcauucugugugucucuaucaugauugaagaggugaugcgcagccggugguccagaaaaaugcucaugaccgggacacuggcuguuuuccuucugcucaucauggcccagcugaccuggaacgaccugauucgccuuugcaucauggugggagccaaugcuucugacaagaugggcaugggcaccacauaucuggcccucauggcgacguuuaaaaugagaccuauguucgcugucgggcugcucuuucggcgccugaccagcagagaggugcuucugcucacaauuggacugucccugguggccucugucgaacuucccaacagccuggaggaacucggcgaugggcuggccaugggaaucaugaugcucaagcugcuuaccgaguuccaaccccaccagcuguggacaacccuccugucccugacguuuaucaaaacaacccuuagccuggacuacgcuuggaagaccacagccaugguucucucuauugugucccuguucccucucugucugagcaccacaucucagaagacgaccuggcuuccggugcugcugggcuccuuugggugcaaaccccucacaauguuccugaucaccgaaaacgagauuuggggaagaaagagcuggccucuuaaugagggcaucauggcuauuggcaucgucucuauccugcucuccagccugcucaaaaacgaugugccccuggccgggccucuuauugcgggaggcaugcugaucgccuguuauguuauuuccgggagcucugcugaccugagccucgaaaaggccgcugagguguccugggaagaggaagccgagcauucuggaacaagccacaauauccuggucgaggugcaggaugacggcaccaugaaaauuaaggaugaagaaagagacgauacgcuuaccauccugcucaaagccacacugcucgcuguuuccgggguguaccccaugucuaucccugcgacccuguuugucugguauuucuggcaaaagaagaaacagagaagcggagugcuuugggacacacccuccccgccugaagucgagcgggccgugcuggaugacggcauuuaccgcauccugcagagaggccuccuggggcggucucagguuggagugggcgucuuccaagaugggguguuucauaccauguggcacguuacacgcggagcugugcuuauguaucagggcaagagacuggagcccagcugggccuccgucaaaaaggaccucauuagcuacgggggaggcuggcgguuccagggcucuuggaacacgggggaagagguccaggugaucgccguugaaccuggcaagaaucccaagaacguccaaaccacaccgggcaccuuuaagaccccugagggggaagugggagcuauugcccuggacuucaaacccggcacauccgggagcccuaucgugaauagagagggaaagauugucggccucuacggcaacggggugguuacgaccucuggaacauauguguccgcgaucgcucaggccaaagccagccaggagggcccccugcccgaaaucgaggaugaagucuuuaagaaacgcaaucuuaccauuauggaccugcacccuggguccggaaagacacggagauaccugccggcuaucgugcgcgaggccauuaagcggaaacucagaacccugauccuugcgcccacgcgcguuguggcuucugaaauggccgaggcccugaagggcaugccuauucgguaucaaacaaccgcugucaaaagcgagcauaccgggagagaaaucguggaucucaugugccacgccacauucaccaugcgccugcugucccccguucgggugccuaacuacaauaugaucauuauggacgaggcucauuuuacagaucccgccagcaucgcggccagaggcuauauuucuacccgggucggaaugggcgaagcugccgcuaucuucaugacggccacaccuccgggguccguggaggccuuuccccagagcaacgcugugauucaggacgaagaacgcgauaucccugagagaucuuggaauagcggauacgacuggaucaccgauuuccccggcaagacagucugguuuguuccuuccauuaaaucugggaacgacaucgcgaauugucuccggaagaacggaaagcgcgugauucagcuuagcagaaaaaccuucgauacggaauaucaaaagaccaaaaacaaugacugggacuacguggucacaaccgauaucuccgagaugggcgccaacuuccgggcugacagagugauugauccccgccggugccugaagccgguuauccugaaagacgggccugaaagagugauucucgccggccccaugcccgucacaguggccucugcugcccagcgccggggaagaaucggccgcaaucagaacaaggagggggaucaguacguuuauaugggacaaccucugaauaacgacgaggaucacgcgcauuggaccgaagcuaagaugcuucuggacaauaucaacacacccgagggcauuaucccugcccucuuugaaccggagcgggaaaagagcgccgcuauugauggggaguacagacugcgcggagaggccagaaagaccuucguggagcugaugcggcgcggcgaccuccccgucuggcuuuccuauaaaguggcgagcgagggguuucaguacucugauagacgguggugcuucgacggcgaacgcaauaaccagguccuggaggaaaauauggauguggagaucuggacgaaggagggagaacgcaagaagcugcggccuagauggcucgacgcccgcacauauuccgacccccuggcccuucgggaguuuaaagaguucgccgcuggcagacgcagcguuuccggggaucugauucucgagaucggaaagcugccucagcaccugacccuccgggcccaaaacgcucuugacaaucuggugaugcugcacaacucugaacagggcgggaaggccuacagacaugcgauggaggagcuccccgauaccaucgaaacacugaugcuucuggcccucauugcugugcugaccggaggcgucacacuguuuuuccucagcggcaaagggcuuggaaagacguccaucggccugcuguguguuaccgccucuagcgcucuccuguggauggccuccguggagccgcacuggauugccgcuagcaucauucuugaauuuuuccugauggugcuccugaucccugagcccgaccggcagcgcacaccucaggauaaucaacuggcguaugucgugaucgggcuccuuuuuaugauucugaccguugccgcuaacgagaugggacugcucgaaacaaccaaaaaggaccugggcaucgggcauguggccgccgagaaccaccagcacgcuacgauucuugaugucgaccugcaucccgccucugcguggacccucuacgccguggcuacaaccgucaucacaccuaugaugagacacaccauugaaaauacgacagccaacaucucccugaccgcuauugccaaucaggcggccauccugaugggacucgauaaaggcuggcccaucagcaagauggaccuuggcgugccgcugcuggcucucgggugcuacucucaaguuaacccucugacacuuaccgccgcugugcugaugcucgucgcccauuaugcuauuaucggacccggccugcaggccaaggcgacccgggaggcccagaaacgcacagcugccgggauuaugaagaaucccacgguggauggaaucguugcuauugaccuggauccuguggucuacgacgccaaauucgaaaagcagcucggccaaaucaugcuucugauccuguguaccucccagauucuccugaugagaacaaccugggcccuuugcgagagcaucacacuggcgaccgggccgcucacgacacugugggagggaucucccggcaaauuuuggaacaccaccauugcugugagcauggccaauaucuuccggggcuccuaucuggcuggggccggacucgccuucucucuuaugaaaagccugggcgggggacgcagaggcacaggggcucagggagaaacccugggcgagaaguggaaacggcagcucaaccaacuguccaagagcgaauuuaauacauacaaacgcuccggcauuauggagguggacagaucugaagccaaggaggggcuuaaacggggagagacgaccaagcacgcgguuagcagaggcacagccaagcugcgcugguucgucgaacggaaccucgugaaaccugaggggaaggugaucgaucugggauguggcagagggggaugguccuauuacugcgcuggccugaaaaaggucaccgaaguuaaaggcuauacaaaagggggacccggccaugaggaaccuauccccauggccaccuacggguggaaucucgugaaacuucacucuggaaaggacguguuuuucaugccuccggagaagugugauacgcugcugugcgacauuggcgagagcucccccaacccuaccaucgaagaggggcgcacacuccggguccugaaaaugguggaacccuggcuuagaggaaaucaguuuuguauuaagauccugaacccuuacaugcccucuguuguggagacccucgagcagaugcagcgcaaacacggcggcaugcugguccggaauccgcugagcagaaacuccacacaugaaauguauugggugagcugcgggaccggaaauauuguuucugcugugaacaugacaucccgcaugcuccugaaccgguucaccauggcccacagaaagccuacguacgagcgcgaugucgaccuuggcgcggggacacggcauguggccguggaacccgaggucgcuaaucuggauaucauuggacaaagaaucgaaaacaucaaaaaugagcacaagagcaccuggcacuaugacgaggauaaccccuacaagaccugggccuaucauggcucuuacgaaguuaaaccuuccgggagcgcuucuuccauggugaauggagugguccgccuccugacaaagcccugggacgugauuccuaugguuacgcagaucgccaugaccgauacaaccccguuuggccagcaaagaguguucaaagagaaggucgacacacggacaccccgcgcuaaaagaggcacagcccagauuauggaagugaccgcgaaguggcuuuggggguuucugagccggaacaagaaaccuagaaucuguacgcgggaggaguucacccgcaagguuagauccaaugccgcuauuggagccguguuugucgacgagaaccaguggaauagcgcuaaagaggccguggaagaugagcgguucugggaccucguucaccgcgaaagagagcugcauaagcagggcaaaugcgccacaugcguguauaacaugauggggaagcgggaaaagaaacugggagaguuuggcaaggcgaaagggucucgcgcuaucugguacauguggcucggcgccagauuccuggaguucgaagcccuuggauuuaugaaugaggaucacugguucagccgggaaaacucccugucuggcgucgagggggagggacuccauaagcugggcuacauccuucgcgacauuagcaaaauccccgggggaaauauguaugcugaugacaccgccggcugggauacaagaauuaccgaagacgaucugcaaaacgaggcuaagaucacggacauuauggaaccugagcacgcccuccuggcgacauccaucuuuaaacugaccuaccagaauaaggugguccgggugcagcgccccgccaagaacgggacaguuauggaugugaucucuagacgggaccagcgcggcagcggacaagucggcaccuaugggcucaacacguucaccaauauggaagugcagcugauuagacagauggaguccgagggaaucuuuuucccgucugaacuugagagcccuaaccuggcugaacgggugcucgauuggcuggagaaacacggcgccgaaagacuuaagcgcauggcuauuuccggggacgacuguguugugaaacccaucgaugaccgguuugccacagcgcugauugcccucaaugauaugggaaaggucagaaaagacaucccucagugggagcccagcaagggcuggaacgauuggcaacaggugccuuucugcucucaucacuuucaucagcugaucaugaaggacgggcgcgagauuguugugcccugucggaaucaggaugaacuggucggcagagcucgcgugucccaaggagccggcuggagccuccgggagaccgcuugccuggggaaaucuuacgcccagauguggcagcuuauguauuuccacagacgcgaccugcggcucgcugccaacgcgaucuguuccgccgucccgguggauuggguuccuacaagcagaaccacaugguccauucacgcucaucaccaauggaugaccacggaagacaugcugucuguguggaaucgcgucuggaucgaggaaaaccccuggauggaggauaagacacaugugagcuccugggaggaaguucccuaccuuggaaaacgggaggaccaguggugcggcagccugauugggcucaccgccagagccaccugggcuacaaauauccagguggccauuaaccagguccggagacugaucggaaaugaaaacuaucuggacuacaugaccucuaugaagcgcuuuaaaaaugaguccgauccugagggcgcgcucugguga

SEQ ID NO: 18467 - RNA, 9879 nt, Artificial Sequence
  derived and/or modified CDS sequence (opt5) from DENV-1__JX669470__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagagcaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggauguccuaugugauguguacgggcagcuucaagcuggagaaggaagucgccgagacacagcacggaaccgugcuuguucaggugaaauacgagggcaccgaugcgccgugcaagauuccuuucucuacacaagacgaaaaaggggucacccagaacggaagacucaucacagcuaaucccaucgugacggauaaggagaaaccugugaacauugaaaccgagccccccuuuggcgaguccuauaucguugucggggccggagaaaaggcccugaagcugagcugguucaaaaagggcucuagcauugggaaaauguuugaggcuacagcccggggcgcuagacgcauggccauccucggagacaccgcgugggauuucggcuccauugggggaguguuuacaucugugggcaagcugguccaucagguguucgggaccgccuacggaguucuuuuuagcggcguguccuggacgaugaaaaucgggaucggcauucugcucaccuggcugggacugaauagccggucuacaucccuuagcaugaccuguaucgucgugggcaugguuacacucuaccugggggugaugguccaggcugacucuggaugcgugauuaacuggaagggcagagaacugaaguguggguccggaaucuucguuaccaacgaggugcacacauggaccgaacaauauaaauuucaggccgauagcccuaagcgccucuccgcugccauuggccgggcgugggaggagggggucugcggcaucagaucugccacgcgccuggaaaauauuauguggaaacagaucagcaacgagcuuaaucauauccugcucgaaaacgacauuaaguucacagugguggucggaaaugcuaacggcauccuggcccaggggaaaaagaugauucggccgcaacccauggagcacaaauacuccuggaagucuuggggaaaggcuaaaaucauuggcgccgacauccagaauaccaccuuuaucauugaugggccugacacacccgaauguccugaugagcagagagccuggaacaucugggagguugaagacuauggauucggcauuuuuaccacgaauaucuggcugaagcuucgcgauagcuacacacagaugugcgaccaccggcucauguccgcugcgauuaaagauagcaaggccgugcaugcugacaugggcuauuggaucgagucugaaaaaaacgagaccuggaagcuggccagagccuccuucaucgaagugaagacauguauuuggcccaaaagccacacccuguggucuaaugggguccucgaguccgagaugaucauuccgaagauguacggaggcccuaucagccaacauaacuaucgccccggguacuucacacagaccgcuggaccuuggcaccugggcaaacuugaacuggauuuugaccucugcgaggggacgaccgugguuguggaugaacacugcggaucucggggccccagccugagaacaaccacagucaccggcaagauuauccaugagugguguugccgguccuguacgcugccuccccuucgcuucagaggggaggacggaugcugguacggcauggaaauccggccggugaaagagaaggaagagaaucucguuagaagcauggugucugccggguccggagaagucgauagcuuuucccugggcauucugugugugucuaucaugauugaggagguuaugcgcagccggugguccagaaagaugcucaugacagggacccuggcgguguuccuucugcucaucaugggacagcugacauggaacgaccugauucgccuuugcaucauggucggcgcuaaugccucugacaaaaugggcauggggaccaccuaucuggcccucauggcuacauuuaagaugagaccuauguucgccgugggacugcucuuucggcgccugacgagcagagaagugcuucugcucaccauuggccugucccuggucgcgucuguugagcuucccaacagccuggaagagcucggggauggacuggcuaugggcaucaugaugcucaaacugcuuacagaauuccaaccccaccagcuguggaccacacuccugucccugaccuuuaucaagacgacacuuagccuggacuacgccuggaaaaccaccgccauggugcucucuauugugucccuguucccucucugucugagcacaaccucucagaagacaacguggcuuccgguccugcugggguccuuuggaugcaagccccucaccauguuccugaucacagagaacgagauuuggggccggaaaagcuggccucuuaaugaaggcaucauggcuguggggauuguuucuauccugcucuccagccugcucaagaacgaugugccccuggccggaccucuuaucgcuggcgggaugcugauugccuguuaugucaucuccggaagcucugcggaccugagccucgagaaagccgcugaaguguccugggaggaagaggccgagcauucuggcaccagccacaauauucugguugaagugcaggaugacgggacaaugaagaucaaagaugaggaacgcgacgauacccuuacgauucugcucaaggcuacccugcucgccgucuccggaguguaccccaugucuaucccugccacacuguuugucugguaucuuuggcaaaaaaagaagcagagaagcggcgugcugugggacacccccuccccgccugagguugagcgggcugugcuggaugacggcaucuaccgcauucuccagagagggcugcuuggacggucucaggucggcguggggguuuuccaagauggaguguuccauacaauguggcacgucacccgcggcgcggugcugauguaucaggggaaaagacucgaacccagcugggccuccgugaagaaagaccugaucagcuacggaggcggcuggcgguuucaggggucuuggaacacaggagaggaaguucaggucauugcuguggagccuggcaagaaucccaaaaacgugcaaacgaccccggggacauucaagaccccugaaggagaggucggcgccaucgcccucgacuuuaagcccgggaccuccggaagcccuauugugaauagagagggcaaaaucguuggccuguacgggaacggaguggucacaacgucuggcaccuauguguccgcuauugcccaggcgaaggcuagccaggaagggccccuucccgagaucgaagaugagguuuucaaaaagcgcaaucugacaaucauggaccugcacccuggauccggcaaaacccggagauaccucccggccauugugcgcgaagccaucaagcggaagcugagaacacuuauucuggcucccacccgcgucguggccucugagauggcggaggcucucaaagggaugccuauccgguaucaaacgacagccguuaagagcgaacauaccggcagagagauuguggaucugaugugccacgccaccuuuacaaugcgccugcucucccccguccgggugccuaacuacaauaugaucaucauggacgaagcucauuucaccgaucccgccagcauugcugccagaggauauaucucuacacgggugggcaugggggaggcggccgcuauuuuuaugaccgccacgccuccgggauccgucgaagcuuucccccagagcaacgccguuauccaggacgaggagcgcgauauuccugaaagaucuuggaauagcggcuacgacuggaucacagauuuucccgggaaaaccgugugguucgugccuuccaucaagucuggaaacgacauugccaauugucuucggaaaaacggcaagcgcgucauccagcugagcagaaagacauuugauaccgaguaucaaaaaacgaagaacaaugacugggacuacgugguuaccacagauauuuccgaaaugggggcuaacuuccgggcggacagagugaucgauccccgccggugccugaaaccggucauucucaaggacggcccugagagagugauccuggccggacccaugcccguuaccguggcuucugccgcccagcgccggggcagaauugggcgcaaucagaacaaagagggagaucaguacgucuauaugggccaaccucuuaauaacgacgaagaucacgcucauuggacagaggccaagaugcugcucgacaauaucaacacccccgaagggaucauuccugcgcuguucgagccggaacgggagaagagcgcugccaucgauggagaguacagacugcgcggcgaagccagaaaaacauuuguggagcucaugcggcgcggggaccuucccgucuggcuguccuauaagguggcuagcgaaggcuuccaguacucugauagacgguggugcuuugacggagagcgcaauaaccagguucuggaagagaauauggauguggagauuuggaccaaagaaggcgagagaaagaaacuccggccuagauggcuggacgcccgcacguauuccgacccccuugcgcugcgggaauucaaggaguuugccgcugggagacgcagcguguccggagaucucauccuggaaauuggcaaacugccucagcaccucacacuucgggcccaaaacgcucuggacaaucuggucaugcuccacaacucugagcaggggggaaaggccuacagacaugcuauggaggaacugcccgauaccaucgagacccuuaugcugcucgcccugaucgcgguucugacaggcggcgugacccucuucuuucuuagcgggaagggacugggcaaaacauccauugggcugcucugugugacggccucuagcgcucugcuuuggauggccuccgucgaaccgcacuggaucgcugccagcauuauccuggaguucuuucucauggugcugcugauuccugagcccgaccggcagcgcaccccucaggauaaucaacucgccuauguugugaucggacuucuguucaugauccugacagucgcugcgaacgaaaugggccuccuggagaccacaaagaaagaccuugggauuggacauguggccgcugaaaaccaccagcacgccaccaugcuggaugucgaccuccaucccgccucugcuuggacgcuguacgccguggcgaccacaguuaucaccccuaugaugagacacacaauugagaauaccacggccaacaucucccugacagcuauugccaaucaggcugccauccucaugggccuugauaagggcuggcccauuagcaaaauggaccugggggugccgcugcucgcgcugggaugcuacucucaagucaacccucuuacccugacagccgcugugcucaugcugguugcccauuaugcuaucaucggccccgggcugcaggccaaggcuacccgggaagcccagaagcgcaccgcggccggaauuaugaaaaaucccacaguggauggcaucgucgcuauugaccucgauccugugguguacgacgccaaguuugagaaacagcuugggcaaaucaugcugcugauucucuguacgucccagauccugcuuaugagaaccacaugggcucugugcgagagcaucacccucgccacaggaccgcugaccacgcugugggaaggcucucccggcaaguucuggaacacaaccauugccguuagcauggcgaauaucuuucggggguccuaucucgcuggagccggccuugcuuucucucugaugaaaagccuggggggaggccgcagagggaccggagcccagggcgagacacucggcgaaaaguggaagcggcagcugaaccaacuuuccaaaagcgaguucaauaccuacaagcgcuccgggauuauggaagucgacagaucugaggccaaagagggacugaagcggggcgaaacaacgaaacacgcugugagcagagggaccgccaagcuccgcugguuuguggagcggaaccuggucaagccugaaggaaaaguuaucgaucugggcugugggagaggaggcugguccuauuacugcgcgggccucaagaaagugacagaggugaagggguauaccaaaggaggccccgggcaugaagagccuauucccauggccacauacggauggaaucuugucaagcugcacucuggcaaagacguguucuuuaugccuccggagaagugugauacccugcucugcgacaucggggaaagcucccccaacccuacgaucgaggaaggacgcacccugcggguucuuaagaugguggagcccuggcugagaggcaaucaguucuguauuaaaauccucaacccuuacaugcccucugucguggagacacuggaacagaugcagcgcaagcacggcgggaugcugguucggaauccgcucagcagaaacuccacccaugagauguauugggugagcugcggaacaggcaauauugucucugcugugaacaugaccucccgcaugcugcuuaaccgguuuacaauggcccacagaaaaccuaccuacgaacgcgauguggaccugggggcuggaacgcggcaugucgccguugagcccgaaguggcgaaucucgauaucauuggccaaagaaucgagaacauuaagaaugagcacaaaagcacauggcacuaugacgaagauaaccccuacaagaccugggccuaucaugggucuuacgaggugaagccuuccggaagcgcuucuuccauggucaauggcgugguucgccugcuuaccaaacccugggacgugaucccuauggucacacagaucgccaugacggauaccacaccguucggccagcaaagaguguuuaaggaaaaaguugacacccggacaccccgcgcuaagagagggaccgcccagauuauggaggugacagcuaaauggcuguggggauuccucagccggaacaagaagccuagaaucuguacccgggaagaguuuacgcgcaaagucagauccaaugccgcgauuggcgccguguucguugacgagaaccaguggaauagcgcuaaggaagccguggaggaugaacgguuuugggaccugguccaccgcgagagagaacugcauaaacaggggaagugcgcuaccugcguguauaacaugaugggaaaacgggagaagaagcucggcgaguucgggaaagccaagggcucucgcgccaucugguacauguggcugggagcgagauuucuugaauucgaggcucugggcuucaugaaugaagaucacugguuuagccgggagaacucccucucuggggucgagggagaaggccugcauaaacuuggguacauucugcgcgacaucagcaagauccccggaggcaauauguaugccgaugacacagccgggugggauaccagaauuacagaggacgaucuccggaacgaagcuaaaaucaccgacauuauggagccugaacacgcccugcuggcuacguccaucuucaagcucacauaccaaaauaaagugguucgcgugcagagacccgccaagaacggcaccgucauggaugugauuucucggcgcgaccagagaggaagcggccagguggggacauauggacugaacaccuuuacgaauauggagguucaacuuauccggcagauggaguccgaaggcaucuucuuuccgucugagcuggaaagcccuaaccucgcggagagagugcuggauuggcuugaaaagcacggggccgagcgccugaaacggauggcuauuuccggagacgacugugucgugaagcccaucgaugacagauucgccaccgcucucauugcccugaaugauaugggcaaaguucgcaaggacaucccucagugggagcccagcaaaggguggaacgauuggcagcaagugccuuuuugcucucaucacuuccaucagcugauuaugaaggacggccgggaaaucgucgugcccuguagaaaucaggaugagcucgucggacgcgcgcgggugucccagggcgccggguggagccugagagaaacagcuugccuuggaaagucuuacgcccaaauguggcagcugauguauuuucaccgccgggaccucagacuggcugccaacgcuaucuguuccgccguuccgguggauugggucccuaccagccgcacaaccugguccauucacgcgcaucaccaguggaugacaaccgaggacaugcuuucuguguggaaucggguuuggaucgaagagaaccccuggauggaggauaaaacgcaugugagcuccugggaagagguccccuaccugggcaagagagaagaccaauggugcgggagccucauuggacugacagcccgggcuaccugggccaccaauauccagguggccauuaaccaggugagacgccugaucggcaaugagaacuaucucgacuacaugacaucuaugaaacgguucaagaaugaguccgauccugaaggggcucugugguga

SEQ ID NO: 18468 - RNA, 9879 nt, Artificial Sequence
  derived and/or modified CDS sequence (opt5) from DENV-1__JX669471__SS-prME
agcgugaccaugcugcugaugcugcuucccaccgcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaggaacaagaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccgcccuuuggcgaguccuauaucguugucggggccggagaaaaggcccugaagcugagcugguucaaaaagggcucuagcauugggaaaauguuugaggcuaccgcccggggcgcuagacgcauggccauccucggagacacagcgugggauuucggcuccauugggggaguguuuaccucugugggcaagcugguccaucagguguucgggacggccuacggaguucuuuuuagcggcguguccuggaccaugaaaaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagaacugaaguguggguccggaaucuucgugacaaacgagguucacaccuggacggaacaauauaaauuucaggcugauagcccuaagcgccucuccgccgcgauuggccgggccugggaggagggggugugcggcaucagaucugcuacacgccuggaaaauauuauguggaaacagaucagcaacgagcuuaaucauauccugcucgaaaacgacauuaaguucaccgucguggugggaaaugccaacggcauccuggcucaggggaaaaagaugauucggccgcaacccauggagcacaaauacuccuggaagucuuggggaaaggccaaaaucauuggcgccgacauccagaauaccacauuuaucauugaugggccugacacccccgaauguccugaugagcagagagcuuggaacaucugggaggucgaagacuauggauucggcauuuuuacgacaaauaucuggcugaaacuucgcgauagcuacacccagaugugcgaccaccggcucauguccgcggccauuaaagauagcaaggcuguucaugccgacaugggcuauuggaucgagucugagaagaacgagacauggaagcuggccagagcuuccuucaucgaagugaagaccuguauuuggcccaaaagccacacacuguggucuaauggggugcucgaguccgagaugaucauuccgaagauguacggaggcccuaucagccaacauaacuaucgccccggguacuucacccagacggccggaccuuggcaccugggcaaacuugaacuggauuuugaccucugcgaggggaccacagucgugguugaugaacacugcggaucucggggccccagccugagaaccacaaccgugacgggcaagauuauccaugagugguguugccgguccuguacacugccuccccuucgcuucagaggggaggacggaugcugguacggcauggaaauccggccggucaaagagaaggaagagaaucucgugagaagcaugguuucugcgggguccggagaaguggauagcuuuucccugggcauucugugugucucuaucaugauugaggaggugaugcgcagccggugguccagaaagaugcucaugaccgggacacuggcuguuuuccuucugcucaucaugggacagcugaccuggaacgaccugauucgccuuugcaucauggugggcgccaaugccucugacaaaaugggcauggggaccacauaucuggcucucauggccacgcugaagaugagaccuauguuugcggucggacuccuguuccggcgccuuaccagcagagaagugcugcuccugacaauuggccugucccuuguggcuucugucgagcugcccaacagccucgaagaacugggggauggacucgccaugggcaucaugaugcugaaacuucugaccgaauuucaaccccaccagcucuggacaacccugcugucccuuacguucaucaagacaacccugagccucgacuacgccuggaaaaccacagcuaugguucugucuauugugucccucuuuccucugugucuuagcaccacaucucagaagacgaccuggcugccggugcugcucggguccuucggaugcaagccccugacaauguuucuuaucaccgagaacgagauuuggggccggaaaagcuggccucugaaugaaggcaucauggccauugggaucgucucuauccuccuguccagccuccugaagaacgaugugccccuugcuggaccucugauugccggcgggaugcugaucgcguguuauguuauuuccggaagcucugccgaccucagccuggagaaagcugccgaaguguccugggaggaagaggcugagcauucuggcacaagccacaauauccuugucgaagugcaggaugacgggaccaugaagauuaaagaugaggaacgcgacgauacgcugaccauccuccugaaggccacacuccuggccguuuccggaguguaccccaugucuaucccugcuacccuuuucgucugguauuuuuggcagaagaagaagcagagaagcggcgugcugugggacacacccuccccgccugaggucgagcgggcggugcuggaugacggcauuuaccgcauccuccagagagggcugcuuggacggucucagguuggcgugggggucuuccaagauggaguguuccauaccauguggcacguuacacgcggcgccgugcugauguaucaggggaaaagacucgaacccagcugggcuuccgucaagaaagaccugauuagcuacggaggcggcuggcgguuucaggggucuuggaacacgggagaggaagugcaagugaucgccguugagccuggcaagaaucccaaaaacguccaaaccacaccggggaccuucaagaccccugaaggagaggugggcgccauugcucucgacuuuaagcccgggacauccggaagcccuaucgugaauagagagggcaaaauugucggccuguacgggaacggagugguuacgaccucuggcacauauguguccgccaucgcgcaggcuaaggccagccaggaagggccccuucccgagaucgaagaugaggucuucaaaaagcgcaaucugaccauuauggaccugcacccuggauccggcaaaacacggagauaccucccggccaucgugcgcgaagcuauuaagcggaagcugagaacccuuauccuggcccccacgcgcguuguggcgucugagauggcugaggcccucaaagggaugccuauucgguaucaaacaaccgccgucaagagcgaacauaccggcagagagaucguggaucugaugugccacgcuacauuuaccaugcgccugcucucccccguucgggugccuaacuacaauaugaucauuauggacgaagcccauuucacaguccccgcuagcaucgccgcgagaggauauauuucuacccgggugggcaugggggaggccgcugccaucuuuaugacggcuacaccuccgggauccguggaagccuucccccagagcaacgccgucauucaggaugaggagcgcgacaucccugaaagaucuuggaauagcggcuacgauuggaucaccgacuuucccgggaaaacaguuugguucgugccuuccauuaagucuggaaacgauaucgcuaauugucuucggaaaaacggcaagcgcgugauucagcugagcagaaagaccuuugacacggaguaucagaaaaccaagaacaaugauugggacuacgucgugacaaccgacaucuccgaaaugggggcgaacuuccgggccgauagaguuauugacccccgccggugccugaaaccggugauccucaaggauggcccugagagagucauucuggcuggacccaugcccgugacaguugccucugccgcucagcgccggggcagaaucgggcgcaaucagaacaaagagggagaccaguacguguauaugggccaaccucuuaauaacgaugaagaccacgcccauuggaccgaggcgaagaugcugcucgauaauaucaacacacccgaagggauuaucccugcucuguucgagccggaacgggaaaagagcgccgccauugacggagaguacagacugcgcggcgaagcuagaaaaaccuuugucgagcucaugcggcgcggggaucuucccguguggcuguccuauaaggucgccagcgaaggcuuccaguacucugacagacgguggugcuuugauggagagcgcaauaaccaggugcuggaagagaauauggacguugagaucuggacgaaagaaggcgagagaaagaaacuccggccuagauggcuggaugcgcgcacauauuccgacccccuugcccugcgggaguucaaggaguuugcugccgggagacgcagcguguccggagaccucauucuggaaaucggcaaacugccucagcaccucacccaacgggcucagaacgcccuugauaaucuggugaugcugcacaacucugagcaagggggaaaggcuuacagacaugccauggaggaacuccccgacaccaucgagacacugaugcuucuggcgcucauugccguccugaccggcggcguuacacuguucuuucucagcgggaagggacuuggcaaaacguccaucgggcugcugugugugaccgcuucuagcgcccuccuguggauggcuuccguggaaccgcacuggauugccgccagcaucauucuugaguucuuucugaugguccuccugaucccugagcccgaucggcagcgcacaccucaagacaaucagcuggcuuaugugguuaucggacuccuuuucaugauucugaccguggcggccaacgaaaugggccugcucgagacaaccaagaaagaucuggggaucggacaugucgcugccgaaaaccaccagcacgccacgaugcuugacguggaucugcaucccgcuucugccuggacccucuacgcggucgccacaaccgugauuacaccuaugaugagacacaccaucgagaauacgacagcuaacauuucccugaccgccaucgcuaaucaagccgcgauucugaugggccucgacaagggcuggcccaucagcaaaauggaucuugggguuccgcugcuggcccucggaugcuacucucaggugaacccucugacacuuaccgcugccguccugaugcucguggcucauuaugccaucauuggccccgggcugcaggcuaaggccacccgggaagcgcagaagcgcacagccgcuggaaucaugaaaaaucccacgguugacggcauuguggccaucgaucuggacccugucguguacgaugcuaaguuugagaaacaacucgggcagauuaugcuucugauccuguguaccucccagauccuccugaugagaacaaccugggcccuuugcgagagcauuacacuggccaccggaccgcucacgacacugugggaaggcucucccggcaaguucuggaacaccaccaucgcggugagcauggcuaauauuuuucggggguccuaucuggccggagcuggccucgccuucucucuuaugaaaagccucgggggaggccgcagagggacaggagcccagggcgagacccugggcgaaaaguggaagcggcaacucaaccagcuguccaaaagcgaguucaauacauacaagcgcuccgggaucauggaaguugacagaucugaggcuaaagagggacuuaagcggggcgaaacgaccaaacacgccgucagcagagggacagcgaagcugcgcugguuuguggagcggaaccucgugaagccugaaggaaaagucauugaccugggcugugggagaggaggcugguccuauuacugcgccggccugaagaaaguuaccgaggugaagggguauacaaaaggaggccccgggcaugaggaaccuauccccauggcuaccuacggauggaaucucgugaaacuucacucuggcaaagaugucuucuuuaugccuccggagaagugugacacgcugcugugcgauaucggggaaagcucccccaacccuaccauugaggaaggacgcacacuccgggugcugaagaugguugagcccuggcuuagaggcaaucaguucuguaucaaaauucugaacccuuacaugcccucuguggucgagacccucgaacagaugcaacgcaagcacggcgggaugcuggugcggaauccgcugagcagaaacuccacacaugagauguauuggguuagcugcggaaccggcaauaucgugucugccgucaacaugacaucccgcaugcuccugaaccgguuuaccauggcucacagaaaaccuacguacgaccgcgauguggaccuuggggccggaacacggcauguggcggucgaacccgagguugccaaucuggauauuaucggccagagaauugaaaacaucaagaaugagcacaaaagcaccuggcacuaugacgaggauaaccccuacaagaccugggcuuaucaugggucuuacgaagugaagccuuccggaagcgccucuuccauggugaauggcgucgugcgccuccugacaaaacccugggacguuaucccuauggugacgcagauugcuaugaccgauacaaccccguucggccaacagagagucuuuaaggagaaaguggacacacggacaccccgcgccaagagagggacagcucagaucauggaaguuaccgccaaauggcuuuggggauuccugagccggaacaagaagccuagaauuuguacgcgggaggaauuuacccgcaaagugagauccaaugcggccaucggcgcugucuucguggacgagaaccaguggaauagcgccaaggaggcuguugaagaugagcgguuuugggaccucgugcaccgcgaaagagagcugcauaaacaagggaagugcgccacaugcgucuauaacaugaugggaaaacgggaaaagaagcugggcgaguucgggaaagccaagggcucucgcgcgauuugguacauguggcucggagcuagauuucuggaguucgaagcccuuggcuucaugaaugaggaucacugguuuagccgggaaaacucccugucugggguggagggagagggccuccauaaacugggguacauccuucgcgacaucagcaagauucccggaggcaauauguaugccgaugacaccgcugggugggauacaagaaucaccgaagacgaucugcagaacgaggccaaaauuacggacaucauggaaccugagcacgcucuccuggccacauccauuuucaagcugaccuaccagaauaaagucgugcggguucagcgccccgcgaagaacggcacagugauggaugucaucucuagacgggaccaacgcggaagcggccagguggggaccuauggacucaacacguuuaccaauauggaagugcagcugaucagacagauggaguccgagggcauuuucuuuccgucugaacuugagagcccuaaccuggccgaacggguucucgauuggcuggagaagcacggggcugaaagacuuaaacgcauggccaucuccggagacgacuguguggucaagcccauugaugaccgguucgcuacagcccugaucgcgcucaaugauaugggcaaagugagaaaggacauuccucaaugggagcccagcaaaggguggaacgauuggcagcagguuccuuuuugcucucaucacuuccaucagcugaucaugaaggacggccgcgagaucgugguccccugucggaaucaagaugaacuggugggcagagcucgcgucucccagggagcuggguggagccuccgggagaccgccugccugggaaagucuuacgcucagauguggcaacuuauguauuuucacagacgcgaccugcggcucgccgcuaacgccauuuguuccgcggugccgguugauugggugccuacaagcagaaccacaugguccauccacgcccaucaccaguggaugaccacggaagacaugcugucugucuggaaucgcguguggauugaggaaaaccccuggauggaggauaaaacacauguuagcuccugggaggaagugcccuaccuuggcaagcgggaggaccaguggugcgggagccugaucggacucaccgcuagagccaccugggccacaaauauucaggucgcuaucaaccaagugcggagacugauuggcaaugaaaacuaucuggacuacaugaccucuaugaaacgcuucaagaaugaguccgauccugagggggcccucugguga

SEQ ID NO: 18469 - RNA, 9879 nt, Artificial Sequence
  derived and/or modified CDS sequence (opt5) from DENV-1__JX669472__SS-prME
agcgugaccaugcugcucaugcugcuucccacagcucuggcuuuccaccucacgacccggggcggggagccucauaugaucguguccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagaacaagaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccgcccuuuggcgaguccuauaucguugucggggccggagaaaaggcccugaagcugagcugguucaaaaagggcucuagcauugggaaaauguuugaggcuaccgcccggggcgcuagacgcauggccauccucggagacacagcgugggauuucggcuccauugggggaguguuuaccucugugggcaagcugguccaucagguguucgggacggccuacggaguucuuuuuagcggcguguccuggaccaugaaaaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagaacugaaguguggguccggaaucuucgugacaaacgagguucacaccuggacggaacaauauaaauuucaggcugauagcccuaagcgccucuccgccgcgauuggccgggccugggaggagggggugugcggcaucagaucugcuacacgccuggaaaauauuauguggaaacagaucagcaacgagcuuaaucauauccugcucgaaaacgacaugaaguucaccgucguggugggaaaugccaacggcauucuggcucaggggaaaaagaugaucaaaccgcaacccauggagcacaaguacuccuggaagucuuggggaaaagccaagauuaucggcgccgacauucagaauaccacauuuaucaucgaugggccugacacccccgaauguccugaugagcagcgggcuuggaacauuugggaggucgaagacuauggauucggcaucuuuacgacaaauauuuggcugaaacuuagagauagcuacacccagaugugcgaccaccgccucauguccgcggccaucaaggauagcaaagcuguucaugccgacaugggcuauuggauugagucugaaaagaacgagacauggaagcuggcccgggcuuccuucaucgaagugaaaaccuguaucuggcccaagagccacacacuguggucuaauggggugcucgaguccgagaugauuaucccgaaaauguacggaggcccuauuagccaacauaacuauagacccggguacuucacccagacggccggaccuuggcaccugggcaaacuugaacuggauuuugaccucugcgaggggaccacagucgugguugaugaacacugcggaucucgcggccccagccugcggaccacaaccgugacgggcaaaaucauucaugagugguguugcagauccuguacacugccuccccuucgguuccgcggggaggacggaugcugguacggcauggaaaucagaccggucaaggagaaggaagagaaucucgugcggagcaugguuucugcgggguccggagaaguggauagcuuuucccugggcauccugugugucucuauuaugaucgaggaggugaugagaagccgcuggucccggaaaaugcucaugaccgggacacuggcuguuuuccuucugcucauuaugggacagcugaccuggaacgaccugaucagacuuugcauuauggugggcgccaaugccucugacaagaugggcauggggaccacauaucuggcucucauggccacguuuaaaaugcgcccuauguucgcggucggacugcucuuuagacggcugaccagccgcgaagugcuucugcucacaaucggccugucccugguggcuucugucgagcuucccaacagccuggaagaacugggggauggacuggccaugggcauuaugaugcucaagcugcuuaccgaguuccaaccccaccagcuguggacaacccuccugucccugacguuuaucaaaacaacccuuagccuggacuacgccuggaagaccacagcuaccguucucucuaucgugucccuguucccucucugucugagcacaacgucucagaagaccacauggcuuccggugcugcugggguccuuuggaugcaaaccccucaccauguuccugauuacagagaacaagaucuggggcagaaaaagcuggccucuuaaugagggcauuauggccaucgggauugucucuauccugcucuccagccugcucaagaacgaugugccccuggcuggaccucuuaucgccggcgggaugcugauugcguguuauguuaucuccggaagcucugccgaccugagccucgaaaaagcugccgagguguccugggaagaggaagcugagcauucuggcaccagccacaauauucuggucgaggugcaggaugacgggacgaugaagaucaaagaugaagaacgggacgauacccuuacaauucugcucaaggccacccugcucgccguuuccggaguguaccccaugucuaucccugcuacacuguuugucugguauuucuggcaaaagaaaaagcagcgcagcggcgugcuuugggacacccccuccccgccugaagucgagagagcggugcuggaugacggcaucuaccggauucugcagcgcgggcuccugggaagaucucagguuggcgugggggucuuccaagauggaguguuucauacaauguggcacguuacgcggggcgccgugcuuauguaucaggggaaacgccuggagcccagcugggcuuccgucaagaaagaccucaucagcuacggaggcggcuggagauuccaggggucuuggaacaccggagaagagguccaggugauugccguugaaccuggcaagaaucccaagaacguccaaacaaccccggggaccuuuaaaacaccugagggagaagugggcgccaucgcucuggacuucaagcccgggacguccggaagcccuauugugaaucgggagggcaaaaucgucggccucuacgggaacggagugguuaccacaucuggcaccuauguguccgccauugcgcaggcuaaggccagccaggaggggccccugcccgaaaucgaggaugaagucuuuaaaaagagaaaucuuacaaucauggaccugcacccuggauccggcaagacccgccgguaccugccggccauugugagagaggcuaucaaacgcaagcuccggacgcugauucuugcccccacaagaguuguggcgucugaaauggcugaggcccugaaagggaugccuauccgcuaucaaaccaccgccgucaagagcgagcauacaggccgggaaauuguggaucucaugugccacgcuaccuucacaaugagacugcugucccccguucgcgugccuaacuacaauaugaucaucauggacgaggcccauuuuaccgaucccgcuagcauugccgcgcggggauauaucucuacgagagucggcaugggggaagccgcugccauuuucaugacagcuaccccuccgggauccguggaggccuuuccccagagcaacgccgugauccaggacgaagaacgggauauuccugagcgcucuuggaauagcggcuacgacuggaucacagauuuccccgggaaaaccgucugguuuguuccuuccaucaagucuggaaacgacauugcuaauugucucagaaagaacggcaaacgggugauccagcuuagccgcaagacguucgauaccgaauaucagaagacaaagaacaaugacugggacuacguggucaccacagauauuuccgagaugggggcgaacuucagagccgaccgggugaucgaucccagacgcugccugaaaccgguuauucugaaggacggcccugaacgggugauccucgcuggacccaugcccgucaccguggccucugccgcucagagacgcggccggauugggagaaaucagaacaaggagggagaucaguacguuuauaugggccaaccucugaauaacgacgaggaucacgcccauuggacagaagcgaaaaugcuucuggacaauaucaacacccccgaggggaucauuccugcucucuuugaaccggagcgcgaaaagagcgccgccaucgauggagaguaccggcugagaggcgaggcucgcaaaacguucguggaacugaugagaagaggggaccuccccgucuggcuuuccuauaagguggccagcgagggcuuucaguacucugaucgcagauggugcuucgacggagaacggaauaaccagguccuggaggaaaauauggauguggagauuuggacaaaagagggcgaacgcaagaaacugagaccucgguggcucgacgcgagaaccuauuccgacccccuggcccuucgcgaguuuaaggaguucgcugccgggcggagaagcguuuccggagaucugauccucgagauuggcaagcugccucagcaccugacccuccgcgcucaaaacgcccuugacaaucuggugaugcugcacaacucugaacaagggggaaaggcuuaccggcaugccauggaggagcuccccgauacaaucgaaacccugaugcuucuggcgcucaucgccgugcugacaggcggcgucacgcuguuuuuccucagcgggaagggacuuggcaaaaccuccauugggcugcuguguguuacagcuucuagcgcccuccuguggauggcuuccguggagccgcacuggaucgccgccagcauuauccuugaauuuuuccugauggugcuccugauuccugagcccgacagacagcggaccccucaggauaaucaacuggcuuaugucgugaucggacuccuuuuuaugauccugacaguugcggccaacgagaugggccugcucgaaaccacgaagaaagaccuggggauuggacauguggcugccgagaaccaccagcacgccaccaugcuugaugucgaccugcaucccgcuucugccuggacacucuacgcgguggccaccacagucaucaccccuaugaugcgccacacgauugaaaauacaaccgcuaacaucucccugacagccauugcuaaucaggccgcgauccugaugggccucgauaagggcuggcccauuagcaagauggaccuuggggugccgcugcuggcccucggaugcuacucucaaguuaacccucugacccuuaccgcugccgugcugaugcucgucgcucauuaugccaucaucggccccgggcugcaggcuaaagccacaagagaggcgcagaagcggacggccgcuggaauuaugaaaaaucccaccguggauggcaucguugccauugaccuggauccuguggucuacgacgcuaaguucgaaaaacagcucgggcaaaucaugcuucugauucuguguacaucccagauccuccugaugcgcaccacaugggcccuuugcgagagcaucacccuggccacgggaccgcucacaacccugugggagggcucucccggcaaguuuuggaacaccacaauugcggugagcauggcuaauaucuucagaggguccuaucuggccggagcuggccucgccuucucucuuaugaaaagccucgggggaggccggcgcgggaccggagcccagggcgaaacacugggcgagaaauggaagagacagcucaaccaacuguccaaaagcgaauuuaauacguacaagcgguccgggauuauggagguggaccgcucugaagcuaaagagggacuuaagagaggcgagaccacaaagcacgccguuagccgggggaccgcgaaacugagaugguucgucgaacgcaaccucgugaagccugagggaaaagugaucgaucugggcugugggcggggaggcugguccuauuacugcgccggccugaagaaagucacagaaguuaagggguauaccaaaggaggccccgggcaugaggaaccuauucccauggcuacguacggauggaaucucgugaaacuucacucuggcaaggacguguuuuucaugccuccggagaaaugugauacccugcugugcgacaucggggagagcucccccaacccuacaaucgaagagggaagaacccuccgcguccugaagaugguggaacccuggcuucggggcaaucaguuuuguauuaaaauccugaacccuuacaugcccucuguuguggagacacucgagcagaugcagagaaagcacggcgggaugcugguccgcaauccgcugagccggaacuccacccaugaaauguauugggugagcugcggaacaggcaauauuguuucugccgugaacaugaccuccagaaugcuccugaaccgcuucacgauggcucaccggaaaccuacauacgagagagaugucgaccuuggggccggaacccgccauguggcgguggaacccgaggucgccaaucuggauaucauuggccaacggaucgaaaacauuaagaaugagcacaagagcaccuggcacuaugacgaggauaaccccuacaaaacaugggcuuaucaugggucuuacgaaguuaagccuuccggaagcgccucuuccauggugaauggcguggucagacuccugacgaaacccugggacgugaucccuaugguuacccagaucgcuaugacagauaccacaccguuuggccagcaacgcguguucaaggagaaagucgacaccagaacaccccgggccaagcgcgggaccgcucagauuauggaagugacggccaaguggcuuuggggauuucugagcagaaacaaaaagccucggaucuguaccagagaggaguucacacggaaaguucgcuccaaugcggccauuggcgcuguguuugucgacgagaaccaguggaauagcgccaaggaggcuguggaagaugagagauucugggaccucguucaccgggaacgcgagcugcauaaacaggggaagugcgcgaccugcguguauaacaugaugggaaagagagagaagaagcugggcgaguuugggaaagccaagggcucucgggccaucugguacauguggcucggagcucgcuuccuggaguucgaagcccuuggcuuuaugaaugaggaucacugguucagcagagaaaacucccugucuggggucgagggagagggccuccauaaacugggguacauucuucgggacaucagcaagauccccggaggcaauauguaugccgaugacacagcugggugggauacccgcauuacggaagacgaucugcaaaacgaggccaaaaucacagacauuauggaaccugagcacgcucuccuggccaccuccaucuuuaagcugacauaccagaauaagguggucagagugcagcggcccgcgaaaaacggcaccguuauggaugugauuucucgcagagaccagcggggaagcggccaagucgggacguauggacucaacaccuucacaaauauggaagugcagcugauccgccagauggaguccgagggcaucuuuuucccgucugaacuugagagcccuaaccuggccgaaagagugcucgauuggcuggagaagcacggggcugaacggcuuaaaagaauggccauuuccggagacgacuguguugugaagcccaucgaugaccgcuuugcuaccgcccugauugcgcucaaugauaugggcaaaguccggaaggacaucccucagugggagcccagcaagggguggaacgauuggcaacaggugccuuucugcucucaucacuuucaucagcugauuaugaaagacggcagagagaucguugugcccugucgcaaucaggaugaacuggucggacgggccagagugucccaaggcgcuggguggagccuccgcgagacagccugccugggaaagucuuacgcucagauguggcagcuuauguauuuccaccggagagaccugcgccucgccgcuaacgccaucuguuccgcggucccgguggauuggguuccuaccagccggacaaccugguccauucacgcccaucaccaauggaugacgacagaagacaugcugucuguguggaauagagucuggaucgaggaaaaccccuggauggaggauaaaacccaugugagcuccugggaggaaguucccuaccuuggcaagcgcgaggaccaguggugcgggagccugauuggacucaccgcucgggccacaugggccaccaauauccagguggcuauuaaccaggucagacggcugaucggcaaugaaaacuaucuggacuacaugacaucuaugaaaagauuuaagaaugaguccgauccugagggggcccucugguga

SEQ ID NO: 18470 - RNA, 9879 nt, Artificial Sequence
  derived and/or modified CDS sequence (opt5) from DENV-1__JX669473__SS-prME
agcgugaccaugcugcuuaugcugcuucccacagcucuggcuuuccaccugacgacccggggcggggagccucauaugaucguguccaagcaggaacggggaaaaucucugcuuuuuaagacaagcgcuggcguuaauaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaauagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagaacaagaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuuccagcgagauccagcugaccgacuacggcgcccucacacuggacuguucucccagaaccggccuugauuucaacgaaauggugcugcucacaaugaaagagaaguccuggcugguccauaaacagugguuucuugaccugccucuccccuggaccagcggggcuuccacgucucaagagacauggaaucggcaggaucugcuggugaccuucaagacagcgcacgccaagaaacaggaagucgugguucucggaagccaagagggcgcuaugcacaccgcccugaccggggccacagaaauucagacguccggaaccacaaccaucuuugcuggccaucuuaagugccgccugaaaauggacaagcucacacugaaagggaccagcuaugugauguguacgggcucuuucaagcuggagaaggaagucgccgagacacagcacggaaccgugcuuguucaggugaaauacgagggcaccgaugcgccgugcaagauuccuuucuccacacaagacgaaaaaggggucacccagaacggaagacucaucacagcuaaucccaucgugacggauaaggagaaaccugugaacauugaaaccgagccgcccuuuggcgagagcuauaucguugucggggccggagaaaaggcccugaagcugucuugguucaaaaagggcagcuccauugggaaaauguuugaggcuacagcccggggcgcuagacgcauggccauccucggagacaccgcgugggauuucggcucuauugggggaguguuuacaagcgugggcaagcugguccaucagguguucgggaccgccuacggaguucucuuuuccggcgugagcuggacgaugaaaaucgggaucggcauucugcucaccuggcugggacucaauucucgguccacaagccuuucuaugaccuguaucgcugucggcauggugacacucuaccuggggguuauggugcaggccgacuccggaugcgucauuaacuggaagggcagagaacugaagugugggagcggaaucuucgugaccaacgagguucacacauggaccgaacaauauaaauuucaggcugauuccccuaagcgccucucugccgcgauuggccgggccugggaggagggggugugcggcaucagaagcgcuacgcgccuggaaaauauuauguggaaacagaucuccaacgagcuuaaucauauccugcucgaaaacgacaugaaguucacagucguggugggaaaugccaacggcauucuggcucaggggaaaaagaugaucaaaccgcaacccauggagcacaaguacucuuggaaaagcuggggaaaggccaagauuaucggcgccgacauucagaaugcuaccuuuaucaucgaugggccugacacccccgaauguccugaugagcagcgggcguggaacauuugggaggucgaagacuauggauucggcaucuuuacaaccaauauuuggcugaaacuuagagauuccuacacgcagaugugcgaccaccgccucaugagcgccgcuaucaaggauucuaaagccguucaugccgacaugggcuauuggauugaguccgaaaagaacgagacauggaagcuggcucgggccagcuucaucgaagugaaaaccuguaucuggcccaagucucacacacugugguccaauggggugcucgagagcgagaugauuaucccgaaaauguacggaggcccuauuucucaacauaacuauagacccggguacuucacccagacagcgggaccuuggcaccugggcaaacuugaacuggauuuugaccucugcgaggggaccacggucgugguugaugaacacugcggaagccgcggccccucccugcggaccacaaccgugacaggcaaaaucauucaugagugguguugcagaagcuguacccugccuccccuucgguuccgcggggaggacggaugcugguacggcauggaaaucagaccggucaaggagaaggaagagaaucucgugcggucuaugguuuccgcugggagcggagaaguggauuccuuuucucugggcauccugugugucagcauuaugaucgaggaggugaugagaucccgcuggucucggaaaaugcucaugacggggacacuggccguuuuccuucugcucauuaugggacagcugaccuggaacgaccugaucagacuuugcauuauggugggcgccaaugcuagcgacaagaugggcauggggacaaccuaucuggcccucauggcgaccuuuaaaaugcgcccuauguucgcugucggacugcucuuuagacggcugacaucccgcgaagugcuucugcucacgaucggccugucucugguggccagcgucgagcuucccaacucccuggaagaacugggggauggacuggccaugggcauuaugaugcucaagcugcuuaccgaguuccaaccccaccagcuguggacaacccuccugagccugacauuuaucaaaaccacgcuuucucuggacuacgcuuggaagacaaccgccaccguucucuccaucgugagccuguucccucucugucugucuacaaccucccagaagacaacguggcuuccggugcugcuggggagcuuuggaugcaaaccccucaccauguuccugauuacagagaacaagaucuggggcagaaaaucuuggccucuuaaugagggcauuauggcuaucgggauugucuccauccugcucagcucccugcucaagaacgaugugccccuggccggaccucuuaucgcgggcgggaugcugauugccuguuauguuaucagcggaucuagcgcugaccugucccucgaaaaagccgcugaggugucuugggaagaggaagccgagcauagcggcaccucccacaauauucuggucgaggugcaggaugacgggacaaugaagaucaaagaugaagaacgggacgauacccuuacgauucugcucaaggccacccugcucgcuguuucuggaguguaccccaugagcaucccugcgacacuguuugucugguauuucuggcaaaagaaaaagcagcgcuccggcgugcuuugggacacccccucuccgccugaagucgagagagccgugcuggaugacggcaucuaccggauucugcagcgcgggcuccugggaagaagccagguuggcgugggggucuuccaagauggaguguuucauacaauguggcacguuacccggggcgcugugcuuauguaucaggggaaacgccuggagcccuccugggccagcgucaagaaagaccucaucucuuacggaggcggcuggagauuccagggguccuggaacacaggagaagagguccaggugauugccguugaaccuggcaagaaucccaagaacguccaaacgaccccggggacauuuaaaaccccugagggagaagugggcgcuaucgcccuggacuucaagcccgggaccagcggaucuccuauugugaaucgggagggcaaaaucgucggccucuacgggaacggagugguuacaacguccggcaccuaugugagcgcgauugcucaggccaaggccucccaggaggggccccugcccgaaaucgaggaugaagucuuuaaaaagagaaaucuuacaaucauggaccugcacccuggaucuggcaagacccgccgguaccugccggcuauugugagagaggccaucaaacgcaagcuccggacacugauucuugcgcccaccagaguuguggcuagcgaaauggccgaggcccugaaagggaugccuauccgcuaucaaacgacagcugucaaguccgagcauaccggccgggaaauuguggaucucaugugccacgccaccuucacaaugagacugcugagccccguucgcgugccuaacuacaauaugaucaucauggacgaggcucauuuuaccgaucccgccucuauugcggcccggggauauaucuccacaagagucggcaugggggaagcugccgcuauuuucaugaccgccacgccuccgggaagcguggaggccuuuccccagucuaacgcugugauccaggacgaagaacgggauauuccugagcgcagcuggaacuccggcuacgacuggaucacagauuuccccgggaaaaccgucugguuuguuccuucuaucaagagcggaaacgacauugcgaauugucucagaaagaacggcaaacgggugauccagcuuucccgcaagacauucgauaccgaauaucagaagacgaagaacaaugacugggacuacguggucaccacagauauuucugagaugggggccaacuucagagcugaccgggugaucgaucccagacgcugccugaaaccgguuauucugaaggacggcccugaacgggugauccucgccggacccaugcccgucaccguggccagcgcugcccagagacgcggccggauugggagaaaucagaacaaggagggagaucaguacguuuauaugggccaaccucugaauaacgacgaggaucacgcgcauuggacagaagcuaaaaugcuucuggacaauaucaacacccccgaggggaucauuccugcccucuuugaaccggagcgcgaaaaguccgccgcuaucgauggagaguaccggcugagaggcgaggcccgcaaaacauucguggaacugaugagaagaggggaccuccccgucuggcuuagcuauaagguggcgucugagggcuuucaguacuccgaucgcagauggugcuucgacggagaacggaauaaccagguccuggaggaaaauauggauguggagauuuggaccaaagagggcgaacgcaagaaacugagaccucgguggcucgacgccagaacguauagcgacccccuggcccuucgcgaguuuaaggaguucgccgcugggcggagauccguuucuggagaucugauccucgagauuggcaagcugccucagcaccugacacuccgcgcccaaaacgcucuugacaaucuggugaugcugcacaacagcgaacaagggggaaaagccuaccggcaugcgauggaggagcuccccgauaccaucgaaacccugaugcuucuggcccucaucgcugugcugacaggcggcgucacccuguuuuuccucuccgggaagggacuuggcaaaacaucuauugggcugcuguguguuacggccagcuccgcucuccuguggauggccagcguggagccgcacuggaucgccgcuucuauuauccuugaauuuuuccugauggugcuccugauuccugagcccgacagacagcggaccccucaggauaaucaacuggcguaugucgugaucggacuccuuuuuaugauccugacaguugccgcuaacgagaugggccugcucgaaaccacaaagaaagaccuggggauuggacauguggccgccgagaaccaccagcacgcuaccaugcuugaugucgaccugcaucccgccuccgcguggacgcucuacgccguggcuaccacagucaucaccccuaugaugcgccacacaauugaaaauaccacggccaacaucagccugacagcuauugccaaucaggcggccauccugaugggccucgauaagggcuggcccauuucuaagauggaccuuggggugccgcugcuggcucucggaugcuacucccaaguuaacccucugacccuuacagccgcugugcugaugcucgucgcccauuaugcuaucaucggccccgggcugcaggccaaagcgaccagagaggcccagaagcggaccgcugccggaauuaugaaaaaucccacaguggauggcaucguugcuauugaccuggauccuguggucuacgacgccaaguucgaaaaacagcucgggcaaaucaugcuucugauucuguguacgagccagauccuccugaugcgcaccacaugggcccuuugcgagucuaucacccuggcgacaggaccgcucaccacgcugugggagggcagccccggcaaguuuuggaacacaaccauugcuguguccauggccaauaucuucagagggucuuaucuggcuggagccggccucgccuucagccuuaugaagucccucgggggaggccggcgcgggaccggagcucagggcgaaacacugggcgagaaauggaagagacagcucaaccaacugagcaaauccgaauuuaauaccuacaagcggucugggauuauggagguggaccgcagcgaagccaaagagggacuuaagagaggcgagacaacgaagcacgcgguuucccgggggaccgccaaacugagaugguucgucgaacgcaaccucgugaagccugagggaaaagugaucgaucugggcugugggcggggaggcuggucuuauuacugcgcuggccugaagaaagucacagaaguuaagggguauaccaaaggaggccccgggcaugaggaaccuauucccauggccacauacggauggaaucucgugaaacuucacagcggcaaggacguguuuuucaugccuccggagaaaugugauacccugcugugcgacaucggggaguccucucccaacccuacgaucgaagagggaagaacccuccgcguccugaagaugguggaacccuggcuucggggcaaucaguuuuguauuaaaauccugaacccuuacaugcccagcguuguggagacacucgagcagaugcagagaaagcacggcgggaugcugguccgcaauccgcugucccggaacagcacccaugaaauguauugggugucuugcggaacaggcaauauuguuuccgcugugaacaugaccagcagaaugcuccugaaccgcuucacaauggcccaccggaaaccuaccuacgagagagaugucgaccuuggggcgggaacgcgccauguggccguggaacccgaggucgcuaaucuggauaucauuggccaacggaucgaaaacauuaagaaugagcacaagucuacauggcacuaugacgaggauaaccccuacaaaaccugggccuaucauggguccuacgaaguuaagccuagcggaucugcuuccagcauggugaauggcguggucagacuccugaccaaacccugggacgugaucccuaugguuacacagaucgccaugacggauaccacaccguuuggccagcaacgcguguucaaggagaaagucgacaccagaacaccccgggcuaagcgcgggaccgcccagauuauggaagugacagcgaaguggcuuuggggauuucuguccagaaacaaaaagccucggaucuguaccagagaggaguucacgcggaaaguucgcagcaaugccgcuauuggcgccguguuugucgacgagaaccaguggaacucugcuaaggaggccguggaagaugagagauucugggaccucguucaccgggaacgcgagcugcauaaacaggggaagugcgcgaccugcguguauaacaugaugggaaagagagagaagaagcugggcgaguuugggaaagccaagggcagccgggcuaucugguacauguggcucggagcccgcuuccuggaguucgaagcccuuggcuuuaugaaugaggaucacugguucuccagagaaaacucucugagcggggucgagggagagggccuccauaaacugggguacauucuucgggacaucuccaagauccccggaggcaauauguaugcugaugacacagccgggugggauacccgcauuacagaagacgaucugcaaaacgaggcuaaaaucaccgacauuauggaaccugagcacgcccuccuggcgacgucuaucuuuaagcugacauaccagaauaagguggucagagugcagcggcccgccaaaaacggcaccguuauggaugugauuagccgcagagaccagcggggauccggccaagucgggacauauggacucaacaccuucacgaauauggaagugcagcugauccgccagauggagucugagggcaucuuuuucccgagcgaacuugaguccccuaaccuggcugaaagagugcucgauuggcuggagaagcacggggccgaacggcuuaaaagaauggcuauuagcggagacgacuguguugugaagcccaucgaugaccgcuuugccaccgcgcugauugcccucaaugauaugggcaaaguccggaaggacaucccucagugggagcccucuaagggguggaacgauuggcaacaggugccuuucugcucccaucacuuucaucagcugauuaugaaagacggcagagagaucguugugcccugucgcaaucaggaugaacuggucggacgggcuagagugagccaaggcgccggguggucucuccgcgagacagcuugccugggaaaguccuacgcccagauguggcagcuuauguauuuccaccggagagaccugcgccucgcugccaacgcgaucuguagcgccgucccgguggauuggguuccuaccucccggacaaccuggucuauucacgcucaucaccaauggaugacaaccgaagacaugcugagcguguggaauagagucuggaucgaggaaaaccccuggauggaggauaaaacgcauguguccagcugggaggaaguucccuaccuuggcaagcgcgaggaccaguggugcgggucucugauuggacucacagcccgggccaccugggcuaccaauauccagguggccauuaaccaggucagacggcugaucggcaaugaaaacuaucuggacuacaugacauccaugaaaagauuuaagaaugagagcgauccugagggggcgcucugguga

SEQ ID NO: 18471 - RNA, 9879 nt, Artificial Sequence
  derived and/or modified CDS sequence (opt5) from DENV-1__JX669474__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagagcaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggauguccuaugugauguguacgggcagcuucaagcuggagaaggaagucgccgagacacagcacggaaccgugcuuguucaggugaaauacgagggcaccgaugcgccgugcaagauuccuuucucuacacaagacgaaaaaggggucacccagaacggaagacucaucacagcuaaucccaucgugacggauaaggagaaaccugugaacauugaaaccgagccccccuuuggcgaguccuauaucguugucggggccggagaaaaggcccugaagcugagcugguucaaaaagggcucuagcauugggaaaauguuugaggcuacagcccggggcgcuagacgcauggccauccucggagacaccgcgugggauuucggcuccauugggggaguguuuacaucugugggcaagcugguccaucagguguucgggaccgccuacggaguucuuuuuagcggcguguccuggacgaugaaaaucgggaucggcauucugcucaccuggcugggacugaauagccggucuacaucccuuagcaugaccuguaucgcugucggcauggugacacucuaccuggggguuauggugcaggccgacucuggaugcgucauuaacuggaagggcagagaacugaaguguggguccggaaucuucgugaccaacgagguucacacauggaccgaacaauauaaauuucaggcugauagcccuaagcgccucuccgccgcgauuggccgggccugggaggagggggugugcggcaucagaucugcuacgcgccuggaaaauauuauguggaaacagaucagcaacgagcuuaaucauauccugcucgaaaacgacaugaaguucacagucguggugggaaaugccaacggcauucuggcucaggggaaaaagaugaucaaaccgcaacccauggagcacaaguacuccuggaagucuuggggaaaagccaagauuaucggcgccgacauucagaaugcuaccuuuaucaucgaugggccugacacccccgaauguccugaugagcagcgggcguggaacauuugggaggucgaagacuauggauucggcaucuuuacaaccaauauuuggcugaaacuuagagauagcuacacgcagaugugcgaccaccgccucauguccgccgcuaucaaggauagcaaagccguucaugccgacaugggcuauuggauugagucugaaaagaacgagacauggaagcuggcucgggccuccuucaucgaagugaaaaccuguaucuggcccaagagccacacacuguggucuaauggggugcucgaguccgagaugauuaucccgaaaauguacggaggcccuaccagccaacauaacuauagacccggguacuucacacagaccgcgggaccuuggcaccugggcaagcuugaacuggauuuugaccucugcgaggggacgaccgucgugguugaugaacacugcggaucucgcggccccagccugcggacaaccacagugaccggcaaaauuauccaugagugguguugcagauccuguacgcugccuccccuucgguuccgcggggaggacggaugcugguacggcauggaaauuagaccggucaaggagaaggaagagaaucucgugcggagcaugguuucugcuggguccggagaaguggauagcuuuucccugggcauccugugugucucuaucaugauugaggaggugaugagaagccgcuggucccggaaaaugcucaugacagggacccuggccguuuuccuucugcucaucaugggacagcugacauggaacgaccugauuagacuuugcaucauggugggcgccaaugcuucugacaagaugggcauggggaccaccuaucuggcccucauggcgacauuuaaaaugcgcccuauguucgcugucggacugcucuuuagacggcugacgagccgcgaagugcuucugcucaccauuggccugucccugguggccucugucgagcuucccaacagccuggaagagcucggggauggacuggccaugggcaucaugaugcucaagcugcuuacagaauuccaaccccaccagcuguggaccacacuccugucccugaccuuuauuaaaacgacacuuagccuggacuacgcuuggaagaccaccgccacaguucucucuaucgugucccuguucccucucugucugagcaccacaucucagaagacgaccuggcuuccggugcugcugggguccuuuggaugcaaaccccucacaauguuccugaucaccgagaacgagauuuggggcagaaagagcuggccucuuaaugaaggcaucauggcuauugggaucgucucuauucugcucuccagccugcucaaaaacgaugugccccuggccggaccucuuaucgcgggcgggaugcugaucgccuguuauguuauuuccggaagcucugcugaccugagccucgagaaggccgcugaaguguccugggaggaagaggccgagcauucuggcacaagccacaauauccuggucgaagugcaggaugacgggaccaugaaaauuaaggaugaggaacgggacgauacgcuuaccauccugcucaaagccacacugcucgcuauuuccggaguuuaccccaugucuaucccugcgacccuguuugugugguauuucuggcaaaagaagaaacagcgcagcggcguccuuugggacacacccuccccgccugagguggagagagccguccuggaugacggcaucuaccggauucugcagcgcgggcuccugggaagaucucaggugggcguugggguguuccaagauggagucuuucauaccauguggcacgugacacggggcgcuguucuuauguaucaggggaagcgccuggaacccagcugggccuccgugaaaaaggaccucaucagcuacggaggcggcuggagauuccaggggucuuggaacacgggagaggaaguccaggugauugccguggagccuggcaaaaaucccaagaacguucaaaccacaccggggaccuuuaagaccccugaaggagaggucggcgcuaucgcccuggacuucaaacccgggacauccggaagcccuauugugaaucgggagggcaagaucgugggccucuacgggaacggagucgugacgaccucuggcacauauguuuccgcgauugcucaggccaaagccagccaggaagggccccugcccgagaucgaagaugagguguuuaagaaaagaaaucuuaccaucauggaccugcacccuggauccggcaagacacgccgguaccugccggcuauugucagagaagccaucaagcgcaaacuccggacccugauucuugcgcccacgagagugguugcuucugagauggccgaggcccugaaggggaugccuauccgcuaucaaacaaccgcugugaaaagcgaacauaccggccgggagauugucgaucucaugugccacgccacauucaccaugagacugcugucccccgugcgcguuccuaacuacaauaugaucaucauggacgaagcucauuuuacagaucccgccagcauugcggcccggggauauaucucuaccagagugggcaugggggaggcugccgcuauuuucaugacggccacaccuccgggauccgucgaagccuuuccccagagcaacgcugugauccaggacgaggagcgggauauuccugaacgcucuuggaauagcggcuacgacuggaucaccgauuuccccgggaagacagugugguuugucccuuccaucaaaucuggaaacgacauugcgaauugucucagaaagaacggcaagcggguuauccagcuuagccgcaaaaccuucgauacggaguaucaaaagaccaaaaacaaugacugggacuacguggugacaaccgauauuuccgaaaugggggccaacuucagagcugaccgggucaucgaucccagacgcugccugaagccggugauucugaaagacggcccugagcggguuauccucgccggacccaugcccgugacagucgccucugcugcccagagacgcggccggauugggagaaaucagaacaaggagggagaucaguacguguauaugggccaaccucugaauaacgacgaagaucacgcgcauuggaccgaggcuaagaugcuucuggacaauaucaacacacccgaagggaucauuccugcccucuuugagccggaacgcgagaaaagcgccgcuaucgauggagaguaccggcugagaggcgaagcccgcaagaccuucguugagcugaugagacggggggaccuccccguguggcuuuccuauaaagucgcgagcgaaggcuuucaguacucugaucgcagauggugcuucgacggagagcggaauaaccaggugcuggaagagaauauggaugucgagauuuggacgaaggaaggcgagcgcaaaaagcugagaccucgguggcucgacgccagaacauauuccgacccccuggcucuucgcgaauuuaaagaguucgccgcugggcggagaagcguguccggagaucugauccucgaaauuggcaagcugccucagcaccugacccuccgcgcccaaaacgcucuugacaaucugguuaugcugcacaacucugagcaggggggaaaggccuaccggcaugcgauggaggaacuccccgauaccaucgagacacugaugcuucuggcccucaucgcugugcugaccggcggcgugacacuguuuuuccucagcgggaaaggacuuggcaagacguccauugggcugcugugugucaccgccucuagcgcucuccuguggauggccuccguugaaccgcacuggaucgccgcuagcauuauccuugaguuuuuccugauggugcuccugauuccugagcccgacagacagcggacaccucaggauaaucaacuggcguauguggucaucggacuccuuuuuaugauccugaccguggccgcuaacgaaaugggccugcucgagacaaccaaaaaggaccuggggauuggacauguugccgccgaaaaccaccagcacgcuacgaugcuugauguggaccugcaucccgccucugcguggacccucuacgccgucgcuacaaccgugaucacaccuaugaugcgccacaccauugagaauacgacagccaacaucucccugaccgcuauugccaaucaggcggccauccugaugggccucgauaaaggcuggcccauuagcaagauggaccuuggggucccgcugcuggcucucggaugcuacucucaagugaacccucugacacuuaccgccgcuguucugaugcucguggcccauuaugcuaucaucggccccgggcugcaggccaaggcgaccagagaagcccagaaacggacagcugccggaauuaugaagaaucccacggucgauggcaucguggcuauugaccuggauccuguuguguacgacgccaaauucgagaagcagcucgggcaaaucaugcuucugauucuguguaccucccagauccuccugaugcgcacaaccugggcccuuugcgagagcaucacacuggcgaccggaccgcucacgacacugugggaaggcucucccggcaaauuuuggaacaccaccauugcugucagcauggccaauaucuucagaggguccuaucuggcuggagccggccucgccuucucucuuaugaagagccuggggggaggccggcgcgggacaggagcucagggcgagacccugggcgaaaaguggaaaagacagcucaaccaacuguccaagagcgaguuuaauacauacaaacgguccgggauuauggaaguggaccgcucugaggccaaggagggacuuaaaagaggcgaaacgaccaagcacgcggugagccgggggacagccaagcugagaugguucguugagcgcaaccucgucaaaccugaaggaaaggugaucgaucugggcugugggcggggaggcugguccuauuacugcgcuggccugaaaaaggugaccgaggucaaaggguauacaaagggaggccccgggcaugaagagccuauucccauggccaccuacggauggaaucucguuaaacuucacucuggcaaggacguguuuuucaugccuccggagaagugugauacgcugcugugcgacaucggggaaagcucccccaacccuaccaucgaggaaggaagaacacuccgcgugcugaaaauggucgagcccuggcuucggggcaaucaguuuuguauuaagauccugaacccuuacaugcccucugugguugagacccucgaacagaugcagagaaaacacggcgggaugcuggugcgcaauccgcugagccggaacuccacacaugagauguauugggucagcugcggaaccggcaauauugugucugcuguuaacaugacauccagaaugcuccugaaccgcuucaccauggcccaccggaagccuacguacgaaagagauguggaccuuggggcgggaacacgccaugucgccguggagcccgaaguggcuaaucuggauaucauuggccaacggaucgagaacauuaaaaaugagcacaagagcaccuggcacuaugacgaagauaaccccuacaagaccugggccuaucaugggucuuacgaggucaaaccuuccggaagcgcuucuuccaugguuaauggcguggugagacuccugacaaagcccugggacgucaucccuauggugacgcagaucgccaugaccgauacaaccccguuuggccagcaacgcguuuucaaagaaaagguggacacaagaaccccccgggcuaaacgcgggacagcccagauuauggaggucaccgcgaaguggcuuuggggauuucugagcagaaacaagaaaccucggaucuguacgagagaagaguucacccggaaggugcgcuccaaugccgcuauuggcgccguuuuuguggacgagaaccaguggaauagcgcuaaagaagccgucgaggaugaaagauucugggaccucgugcaccgggagcgcgaacugcauaagcaggggaaaugcgccacaugcguuuauaacaugaugggaaagagagagaagaaacugggcgaguuugggaaggcgaaaggcucucgggcuaucugguacauguggcucggagcccgcuuccuggaauucgaggcccuuggcuuuaugaaugaagaucacugguucagcagagagaacucccugucugggguggagggagaaggccuccauaagcugggguacauucuucgggacaucagcaaaauccccggaggcaauauguaugcugaugacaccgccgggugggauacacgcauuaccgaggacgaucugcaaaacgaagcuaagaucacggacauuauggagccugaacacgcccuccuggcgacauccaucuuuaaacugaccuaccagaauaaggucgugagaguccagcggcccgccaagaacggcacagugauggauguuauuucucgcagagaccagcggggaagcggccaaguggggaccuauggacucaacacguucaccaauauggagguccagcugauccgccagauggaguccgaaggcaucuuuuucccgucugagcuugaaagcccuaaccuggcugagagagugcucgauuggcuggaaaaacacggggccgagcggcuuaagagaauggcuauuuccggagacgacugugugguuaaacccaucgaugaccgcuuugccacagcgcugauugcccucaaugauaugggcaaggugcggaaagacaucccucagugggagcccagcaagggguggaacgauuggcaacaggucccuuucugcucucaucacuuucaucagcugauuaugaaggacggcagagaaaucgugguucccugucgcaaucaggaugagcuggugggacgggcuagagucucccaaggcgccggguggagccuccgcgaaaccgcuugccugggaaaaucuuacgcccagauguggcagcuuauguauuuccaccggagagaccugcgccucgcugccaacgcgaucuguuccgccgugccggucgauugggugccuacaagccggaccacaugguccauucacgcucaucaccaauggaugaccacggaggacaugcugucuguuuggaauagaguguggaucgaagagaaccccuggauggaggauaagacacaugucagcuccugggaagaggugcccuaccuuggcaaacgcgaagaccaguggugcgggagccugauuggacucaccgcccgggccaccugggcuacaaauauccagguugccauuaaccaggugagacggcugaucggcaaugagaacuaucuggacuacaugaccucuaugaagagauuuaaaaaugaguccgauccugaaggggcgcucugguga

SEQ ID NO: 18472 - RNA, 9879 nt, Artificial Sequence
  derived and/or modified CDS sequence (opt5) from DENV-1__JX669475__SS-prME
agcgugaccaugcugcucaugcugcuucccaccgcccuggcuuuccaccucacgaccagaggcggggagccucauaugaucguguccaagcaggaacggggaaagucucugcuuuuuaagacaagcgccggcguuaauaugugcacccugauugcgauggaccucggggagcugugugaagauacaaugaccuacaaaugcccccgcauuacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaauagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagaacaagaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccgcccuuuggcgaguccuauaucguugucggggccggagaaaaggcccugaagcugagcugguucaaaaagggcucuagcauugggaaaauguuugaggcuaccgcccggggcgcuagacgcauggccauccucggagacacagcgugggauuucggcuccauugggggaguguuuaccucugugggcaagcugguccaucagguguucgggacggccuacggaguucuuuuuagcggcguguccuggaccaugaaaaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagaacugaaguguggguccggaaucuucgugacaaacgagguucacaccuggacggaacaauauaaauuucaggcugauagcccuaagcgccucuccgccgcgauuggcaaagccugggaggagggggugugcggcauccggucugcuacaagacuggaaaauauuauguggaagcagaucagcaacgagcuuaaucauauccugcucgaaaacgacauuaaauucaccgucguggugggaaaugccaacggcauccuggcucaggggaagaaaaugauucgcccgcaacccauggagcacaaguacuccuggaagucuuggggaaaagccaagaucauuggcgccgacauccagaauaccacauuuaucauugaugggccugacacccccgaauguccugaugagcagcgggcuuggaacaucugggaggucgaagacuauggauucggcauuuuuacgacaaauaucuggcugaaacuuagagauagcuacacccagaugugcgaccaccgccucauguccgcggccauuaaggauagcaaagcuguucaugccgacaugggcuauuggaucgagucugaaaagaacgagacauggaagcuggcccgggcuuccuucaucgaagugaaaaccuguauuuggcccaagagccacacacuguggucuaauggggugcucgaguccgagaugaucauuccgaaaauguacggaggcccuaucagccaacauaacuauagacccggguacuucacccagacggccggaccuuggcaccugggcaaacuugaacuggauuuugaccucugcgaggggaccacagucgugguugaugaacacugcggaucucgcggccccagccugcggaccacaaccgugacgggcaaaauuauccaugagugguguugcagauccuguacacugccuccccuucgguuccgcggggaggacggaugcugguacggcauggaaaucagaccggucaaggagaaggaagagaaucucgugcggagcaugguuucugcgggguccggagaaguggauagcuuuucccugggcauucugugugucucuaucaugauugaggaggugaugagaagccgcuggucccggaaaaugcucaugaccgggacacuggcuguuuuccuucugcucaucaugggacagcugaccuggaacgaccugauuagacuuugcaucauggugggcgccaaugccucugacaagaugggcauggggaccacauaucuggcucucauggccacguuuaaaaugcgcccuauguucgcggucggacugagcuuuagacggcucaccucccgcgaagugcugcuucugacaauuggccucucucugguggcuagcgucgagcugcccaacucccuugaagaacugggggauggacucgccaugggcaucaugaugcugaagcuccugaccgaguuccaaccccaccagcuuuggacaacccugcucagccugacguuuaucaaaacaacccugucucuugacuacgccuggaagaccacagcuaugguucuguccauugugagccucuucccucugugucucucuaccacaucccagaagacgaccuggcugccggugcuucuggggagcuuuggaugcaaaccccugacaauguuccucaucaccgagaacgagauuuggggcagaaagucuuggccucugaaugaaggcaucauggccauugggaucgucuccauccuucugagcucccuccugaaaaacgaugugccccucgcuggaccucugauugccggcgggaugcuuaucgcguguuauguuauuagcggaucuagcgccgaccugucccuggagaaggcugccgaagugucuugggaggaagaggcugagcauagcggcacaucccacaauauccucgucgaagugcaggaugacgggaccaugaaaauuaaggaugaggaacgggacgauacgcugaccauccuucugaaagccacacuccuggccguuucuggaguguaccccaugagcaucccugcuacccucuuugucugguauuucuggcaaaagaagaaacagcgcuccggcgugcugugggacacacccucuccgccugaggucgagagagcggugcuugaugacggcauuuaccggauccugcagcgcgggcugcucggaagaagccagguuggcgugggggucuuccaagauggaguguuucauaccauguggcacguuacacggggcgccgugcugauguaucaggggaagcgccuugaacccuccugggcuagcgucaaaaaggaccugauuucuuacggaggcggcuggagauuccagggguccuggaacacgggagaggaaguccaggugaucgccguugagccuggcaaaaaucccaagaacguccaaaccacaccggggaccuuuaagaccccugaaggagaggugggcgccauugcucucgacuucaaacccgggacaagcggaucuccuaucgugaaucgggagggcaagauugucggccuguacgggaacggagugguuacgaccuccggcacauaugugagcgccaucgcgcaggcuaaagccucccaggaagggccccuccccgagaucgaagaugaggucuuuagaaagcgcaaucugaccauuauggaccuucacccuggaucuggcaaaacacggagauaccugccggccaucgugcgcgaagcuauuaagcggaagcugagaacccucauccuggcccccacgcgcguuguggcgagcgagauggcugaggcccuuaaagggaugccuauucgguaucaaacaaccgccgucaaguccgaacauaccggcagagagaucguggaucugaugugccacgcuacauucaccaugcgccuccugagccccguucgggugccuaacuacaauaugaucauuauggacgaagcccauuuuacagaucccgcuucuaucgccgcgagaggauauauuuccacccgggucggcaugggggaggccgcugccaucuucaugacggcuacaccuccgggaagcguggaagccuuuccccagucuaacgccgugauucaggacgaggagcgcgauaucccugaaagaagcuggaacuccggcuacgacuggaucaccgauuuccccgggaaaacagucugguuuguuccuucuauuaagagcggaaacgacaucgcuaauugucugcggaaaaacggcaagcgcgugauucagcucuccagaaagaccuucgauacggaguaucagaagaccaagaacaaugacugggacuacguggucacaaccgauaucucugaaaugggggcgaacuuccgggccgacagagugauugauccccgccggugccuuaaaccgguuauccugaaggacggcccugagagagugauucuggcuggacccaugcccgucacaguggccagcgccgcucagcgccggggcagaaucgggcgcaaucagaacaaagagggagaucaguacguuuauaugggccaaccucucaauaacgacgaagaucacgcccauuggaccgaggcgaagaugcugcuugacaauaucaacacacccgaagggauuaucccugcucuguuugagccggaacgggagaaguccgccgccauugauggagaguacagacuccgcggcgaagcuagaaaaaccuucguggagcugaugcggcgcggggaccugcccgucuggcucagcuauaagguggccucugaaggcuuucaguacuccgauagacgguggugcuucgacggagagcgcaauaaccagguccuugaagagaauauggauguggagaucuggacgaaagaaggcgagagaaagaaacugcggccuagauggcuggacgcgcgcacauauagcgacccccucgcccugcgggaauuuaaggaguucgcugccgggagacgcuccguuucuggagaucuuauucuggaaaucggcaaacucccucagcaccugacccugcgggcucaaaacgcccucgacaaucuugugaugcugcacaacagcgagcaagggggaaaggcuuacagacaugccauggaggaacugcccgauaccaucgagacacucaugcugcuugcgcugauugccgugcucaccggcggcgucacacuguuuuuccuguccgggaagggacucggcaaaacgucuaucgggcuucuguguguuaccgcuagcuccgcccugcucuggauggcuagcguggaaccgcacuggauugccgccucuaucauucuggaguuuuuccuuauggugcugcucaucccugagcccgaccggcagcgcacaccucaggauaaucaacuggcuuaugucgugaucggacugcucuuuaugauucuuaccguugcggccaacgaaaugggccugcuggagacaaccaagaaagaccucgggaucggacauguggcugccgaaaaccaccagcacgccacgaugcuggaugucgaccuucaucccgcuuccgccuggacccuguacgcgguggccacaaccgucauuacaccuaugaugagacacaccaucgagaauacgacagcuaacauuagccucaccgccaucgcuaaucaggccgcgauucugaugggccuggauaagggcuggcccaucucuaaaauggaccucggggugccgcuucuggcccugggaugcuacucccaaguuaacccucucacacugaccgcugccgugcuuaugcuggucgcucauuaugccaucauuggccccgggcuccaggcuaaggccacccgggaagcgcagaagcgcacagccgcuggaaucaugaaaaaucccacgguggauggcauuguugccaucgaccuggauccuguggucuacgacgcuaaguucgagaaacagcuggggcaaauuaugcuccuuauccuguguaccagccagauccugcucaugagaacaaccugggcccugugcgagucuauuacacuugccaccggaccgcugacgacacucugggaaggcagccccggcaaguuuuggaacaccaccaucgcgguguccauggcuaauauuuuccgggggucuuaucuggccggagcuggccuggccuucagccucaugaaaucccuugggggaggccgcagagggacaggagcccagggcgagacccugggcgaaaaguggaagcggcagcugaaccaacucagcaaauccgaguuuaauacauacaagcgcucugggaucauggaaguggacagaagcgaggcuaaagagggacugaagcggggcgaaacgaccaaacacgccguuuccagagggacagcgaaacuucgcugguucgucgagcggaaccuggugaagccugaaggaaaagugauugaucucggcugugggagaggaggcuggucuuauuacugcgccggccugaagaaagucaccgagguuaagggguauacaaaaggaggccccgggcaugaggaaccuauccccauggcuaccuacggauggaaucuggugaagcuccacagcggcaaagacguguuuuucaugccuccggagaagugugauacgcuucugugcgacaucggggaauccucucccaacccuaccauugaggaaggacgcacacugcggguccucaagaugguggagcccuggcugagaggcaaucaguuuuguaucaaaauucuuaacccuuacaugcccagcguuguggagacccuggaacagaugcagcgcaagcacggcgggaugcucguccggaauccgcuguccagaaacagcacacaugagauguauugggugucuugcggaaccggcaauaucguuuccgccgugaacaugacaagccgcaugcugcucaaccgguucaccauggcucacagaaaaccuacguacgaacgcgaugucgaccugggggccggaacacggcauguggcgguggagcccgaagucgccaaucuugauauuaucggccaaagaauugagaacaucaagaaugagcacaaaucuaccuggcacuaugacgaagauaaccccuacaagaccugggcuuaucauggguccuacgagguuaagccuagcggaucugccuccagcauggugaauggcgugguccgccugcucacaaaacccugggacgugaucccuaugguuacgcagauugcuaugaccgauacaaccccguuuggccagcaaagaguguucaaggaaaaagucgacacacggacaccccgcgccaagagagggacagcucagaucauggaggugaccgccaaauggcuguggggauuucuuucccggaacaagaagccuagaauuuguacgcgggaagaguucacccgcaaaguuagaagcaaugcggccaucggcgcuguguuugucgacgagaaccaguggaacucugccaaggaagcuguggaggaugaacgguucugggaccugguucaccgcgagagagaacuccauaaacaggggaagugcgccacaugcguguauaacaugaugggaaaacgggagaagaagcugggcgaguuugggaaagccaagggcagccgcgcgauuugguacauguggcugggagcuagauuccucgaguucgaggcccugggcuuuaugaaugaagaucacugguucucccgggagaacucucuuagcggggucgagggagaaggccugcauaaacucggguacauccugcgcgacaucuccaagauucccggaggcaauauguaugccgaugacaccgcugggugggauacaagaaucaccgaggacgaucuucaaaacgaagccaaaauuacggacaucauggagccugaacacgcucugcucgccacaucuauuuuuaagcugaccuaccagaauaaagugguccgggugcagcgccccgcgaagaacggcacaguuauggaugugaucagcagacgggaccagcgcggauccggccaagucgggaccuauggacugaacacguucaccaauauggaggugcagcucaucagacagauggagucugaaggcaucuuuuucccgagcgagcuggaauccccuaaccuugccgagcgggugcuggauuggcucgaaaagcacggggcugagagacugaaacgcauggccaucagcggagacgacuguguugugaagcccauugaugaccgguuugcuacagcccuuaucgcgcugaaugauaugggcaaagucagaaaggacauuccucagugggagcccucuaaaggguggaacgauuggcaacaggugccuuucugcucccaucacuuucaucagcucaucaugaaggacggccgcgaaaucguugugcccugucggaaucaggaugagcuggucggcagagcucgcgugagccaaggagcuggguggucucugcgggaaaccgccugccucggaaaguccuacgcucagauguggcagcugauguauuuccacagacgcgaccuucggcuggccgcuaacgccauuuguagcgcggucccgguggauuggguuccuacauccagaaccacauggucuauccacgcccaucaccaauggaugaccacggaggacaugcucagcguguggaaucgcgucuggauugaagagaaccccuggauggaggauaaaacacauguguccagcugggaagagguucccuaccugggcaagcgggaagaccaguggugcgggucucuuaucggacugaccgcuagagccaccugggccacaaauauucagguggcuaucaaccagguccggagacucauuggcaaugagaacuaucuggacuacaugaccuccaugaaacgcuuuaagaaugagagcgauccugaaggggcccugugguga

SEQ ID NO: 18473 - RNA, 9879 nt, Artificial Sequence
  derived and/or modified CDS sequence (opt5) from DENV-1__JX669461__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacgugaauggcauccuugcucaggggaagaaaaugauucgcccgcaacccauggagcauaaguauagcuggaaguccuggggaaaagccaagaucauuggcgcugauauccagaacaccaccuuuaucauugacgggccugauacacccgaauguccugacgaucagcgggccuggaauaucugggaggucgaggacuacggauucggcauuuuuaccacgaacaucuggcucaaacugagagauucucacacacagaugugcgaccaccgccugaugagcgccgcuauuaaggauuccaaagcgguucaugccgacaugggcuauuggaucgaaagcgagaagaaugaaaccuggaagcucgcucgggccucuuucaucgaggugaaaacauguauuuggcccaagucccacacccuguggagcaacggggugcuugaaucugagauggucaucccgaaaauuuacggaggcccuaucucccaacauaauuauagacccggguacuucacacagaccgccggaccuuggcaccugggcaagcucgagcuggauuuugaccugugcgaagggacgaccgugguuguggaugagcacugcggauaccgcggccccagccuucggacaaccacagucaccggcaaaauuauccaugaaugguguugcagaucuuguacgcucccuccccugcgguuccgcggggaggacggaugcugguauggcauggagaucagaccggugaaggaaaaggaggaaaaccugguucggagcaugguguccgcugggagcggagagauggacucuuuuucccucggcauucugugugucagcauccuuauugaagaggugaugagaucccgcuggucucggaaaaugcugaugacagggacccucgccguuuuccugcugcuuaucaugggacagcugacauggaaugaucucauuagacugugcaucauggugggcgcgaacgcuagcgacaagaugggcauggggaccaccuaccucgcccugauggccacacuuaaaaugcgcccuauguuugcugucggacugcucuucagacggcugacgucccgcgaggugcugcuucugaccgugggccucucucuggucgccagcguugaacuccccaauucccuggaggaacuuggggauggacuggcgaugggcauuaugaugcucaagcugcugacagacuuucaaccccaccagcuuuggaccacacugcucucucugaccuucaucagaacgagccucucccuggauuaugcuuggaaaacaauggccauggcccuuagcaucgugucucuguuuccucugugucucuccaccaccagccagaagacaaccuggcugccggugcuucuggggucuuucggaugcaagccccucacaauguuucugauuacggagaacaaaaucuggggccggaaguccuggccuauuaacgaaggcaucauggcugucgggauugugagcauccuccugucuucccuucugaaaaaugacguuccccuggccggaccucucaucgcuggcgggaugcugauugccuguuacgugaucagcggauccagcgcggaucuuucucuggagaaggccgcugaggucagcugggaagaggaagccgagcauuccggcaccucucacaacauucucguggaaguucaggacgaugggacaaugaaaaucaaggacgaggagcgcgaugacacccugacaauucuccugaaagcuacccuucuggccgugagcggagucuaucccauguccaucccugccacgcuguucgugugguacuuuuggcaaaagaagaaacagagaucuggcguccucugggauacccccagcccgccugaaguggagcgggcuguucuggacgacggcaucuaucgcauucuucagagagggcugcucggacggucccaggugggcgucgggguguuccaagauggaguuuuccauacaauguggcacgugacccgcggcgcgguccugauguaccaggggaagagacucgaacccucuugggccagcgugaaaaaggaccugaucuccuacggaggcggcuggcgguuucaggggagcuggaauacaggagaggaggugcagguuauugcugucgaaccuggcaaaaaccccaagaaugugcaaaccacaccggggacguucaagaccccugagggagaagugggcgccaucgcccuugauuuuaaacccgggacaucuggauccccuauugucaacagagagggcaagaucgugggccuguaugggaauggaguugugaccaccagcggcacauacgucucugcuauugcccaggcgaaagcuacgcaggaagggccccugcccgagaucgaggacgaaguguucaagaaacgcaaccucaccaucauggaucugcacccuggauccggcaagacacggagauaucuuccggccauuguucgcgaggccaucaagcggaaacugagaacccucauucuggcucccacacgcguggucgccagcgaaauggcggaggcucugaaggggaugccuauccgguaccaaaccacggccgugaaauccgaacauacaggcagagagauuguugaccucaugugccacgccaccuuuaccaugcgccuucugucucccgugcgggucccuaauuauaacaugaucaucauggaugaggcucauuucacagaccccgccagcauugcugccagaggauacaucuccacccgggugggcaugggggaagcggccgcuauuuuuaugacagccaccccuccgggaagcguggaggcuuucccccagucuaaugccgucauccaggaugaagagcgcgacauuccugaaagauccuggaacagcggcuaugauuggaucacggacuuucccgggaagacaguuugguucgugccuucuaucaaaagcggaaaugacauugccaacugucugcggaagaauggcaagcgcgugauccagcucuccagaaaaaccuuugauacagaguaccaaaagaccaaaaacaacgacugggauuacgucgugacgaccgacauuucugagaugggggcuaauuuccgggcggauagaguuaucgacccccgccggugccugaagccggugauucuuaaagaaggcccugagagagucauccuggccggacccaugcccgugacaguugcuagcgccgcccagcgccggggcagaauugggcgcaaccagaauaaggaaggagaucaguauaucuacaugggccaaccucucaacaaugacgaggaucacgcucauuggaccgaggccaagaugcugcuggacaacaucaauacacccgaagggauuaucccugcgcucuucgagccggaacgggagaaauccgcugccauugauggagaauauagacuucgcggcgaggccagaaagaccuuuguggagcugaugcggcgcggggaccugcccgucuggcucucuuacaaaguggcuagcgaaggcuuccaguauuccgauagacgguggugcuuugacggagagcgcaacaaucagguccuggaagagaacauggacguggaaaucuggacaaaggagggcgagagaaaaaagcuucggccuagauggcuggaugcccgcaccuacagcgacccccucgcgcugcgggaauucaaagaguuugccgcugggagacgcucuguuuccggagaucugauucucgaaaucggcaagcuuccucagcaccugacgcugcgggcccaaaaugcucucgacaaccuggugaugcuucacaauagcgagcaggggggaaaggccuauagacaugcuauggaagagcugcccgauacaaucgagacccucaugcugcuggcccucauugcggugcuuaccggcggcgucacacuguucuuucuguccgggaaaggacucggcaagaccucuaucgggcugcuuuguguuauggccagcuccgcucugcucuggauggccucuguggaaccgcacuggauugcugccagcaucauucuggaguucuuucugauggugcuccuuaucccugaacccgaccggcagcgcacaccucaggauaaccaacuggccuacgucgugaucggacugcucuucaugauucugacgguugcugcgaaugagaugggccuucuggagaccacaaaaaaggaccucgggaucggacauguggccgucgaaaaccaccaccaugcuaccaugcuggauguggaccugagacccgccuccgccuggacacucuacgcugucgccaccacggugauuaccccuaugaugcggcacacaaucgagaacaccacagcgaauauuagccuuaccgccaucgcuaaccaggccgcuauucugaugggccuggauaaaggcuggcccaucucuaagauggacaucgggguuccgcuccuggcccuuggaugcuauucccaggugaauccucugacgcucacagcggccguccugaugcugguggcucauuacgccauuaucggccccgggcuccaagcuaaggccacccgcgaagcucagaaaagaacagccgcgggaauuaugaagaaccccaccguugauggcaucgugaccauugaccuugacccugucguguaugaugccaaauuugagaagcagcuggggcagaucaugcugcucauccuguguacaagccaaauucuucugaugcggacgaccugggcucucugcgaaucuaucacacuggccaccggaccgcugacaacccucugggagggcucccccggcaaauucuggaauacgacaauugcugugagcauggccaacaucuuucgcgggucuuaccuugccggagcgggccuggcuuucagccugaugaagucccucgggggaggcagacgggggaccggagcccagggcgagacccugggcgaaaaguggaaacgccagcuuaaucagcugucuaagagcgaguucaacacauauaaaaaguccgggauuauggaaguugacagaagcgaggcuaaagaaggacucaagcggggcgagaccacaaagcacgccgucuccagagggacggccaaacugcgcugguuuguggagcggaaucuggugaagccugaaggaaaagucaucgaucucggcugugggagaggaggcuggucuuacuauugcgcuggccuuaagaaaguuaccgaggugaagggguacacaaaaggaggccccgggcaugaagagccuauccccauggccaccuacggauggaaccuggugaagcugcacagcggcaaggacgucuucuuuacaccuccggaaaaaugugauacccuccugugcgacauuggggaguccucucccaauccuacgaucgaggaaggacgcacccuucgggugcugaagaugguugagcccuggcucagaggcaaccaauucuguauuaaaauccugaauccuuauaugcccagcguggucgaaacacuggagcagaugcagcgcaagcacggcgggaugcucgugcggaacccgcuguccagaaauucuacccaugagauguacuggguuagcugcggaacaggcaacauuguguccgcggucaauaugaccagccgcaugcuucugaaccgguuuacaauggcccacagaaaaccuaccuaugaacgcgauguggaccucggggcuggaacgcggcauguggccgucgagcccgaaguugcuaaccuggauaucauuggccagagaaucgagaauaucaagaacgaacacaagucuacauggcacuacgacgaggauaaucccuauaaaaccugggccuaccauggguccuaugaggugaagccuagcggaucugcguccagcauggugaacggcgucgugcgccuucugaccaaacccugggacguuauuccuauggugacacaaaucgccaugacggacaccacaccguucggccagcagagagucuuuaaggaaaaaguggauacccggacaccccgcgcuaagagagggaccgcccaaauuauggagguuacagcuaaguggcucuggggauuccugucucggaauaaaaagccuagaaucuguacccgggaagaguuuacgcgcaaagugagauccaacgccgcuauuggcgccgucuucguggacgaaaaucaguggaacagcgcgaaggaggccguugaggaugaacgguuuugggaccuggugcaccgcgagagagaacuccauaaacaggggaagugcgcuaccugcgucuacaauaugaugggaaagcgggagaaaaagcugggcgaauucgggaaagccaagggcucccgcgcuaucugguacauguggcuuggagccagauuucuggaguucgaggcccucggcuucaugaacgaagaucacugguuuagccgggagaauucucugagcgggguggaaggagagggccuucauaaacugggguauauccuccgcgacauuuccaagauccccggaggcaacauguacgcggaugacacagcugggugggauaccagaauuacagaggacgaucugcagaaugaagccaaaaucaccgacauuauggagccugaacacgcccugcucgcuacgucuaucuucaagcugacauaucaaaacaaggucgugcggguucagcgccccgccaaaagcggcaccgugauggaugucaucuccagacgggaccagcgcggaucuggccagguggggacauacggacuuaauaccuuuacgaacauggaggugcaacugauuagacagauggaaagcgagggcaucuucuccccgucugagcucgaaaccccuaaccuggcuaagaaaguucuugacuggcuggagaagcacggggccgaacggcucaaaagaauggcgauuagcggagaugacuguguggucaagcccaucgaugaccgcuuugccacagcucugaccgcccugaaugauaugggcaaggugcggaaagacauuccucagugggagcccuccaagggguggaacgauuggcagcaaguuccuuucugcagccaucacuuucaucagcucaucaugaaagacggcagagaaaucgugguccccugucgcaaucaggaugagcuggugggacgggcuagagucucucagggcgccggguggucccuucgcgagacagcgugccugggaaagagcuaugcccaaauguggcagcucauguacuuccaccggagagaccugcgccuugcugccaacgcuauuuguucugccgugccgguugauugggugccuaccucccggacaaccuggagcauccacgcucaucaccaguggaugacgacagaagacaugcuguccgucuggaauagaguguggauugaggaaaaccccuggauggaggacaaaacccauguuucuagcugggaagaggugcccuaucucggcaagcgcgaggaucaauggugcgggucccugaucggacugaccgcccgggcgacaugggccaccaauauucaggucgcuaucaaccaggugagacggcucauuggcaaugaaaacuaccuggacuacaugacaagcaugaagagauuuaaaaaugagucugauccugaaggggcccuuugguga

SEQ ID NO: 18474 - RNA, 9879 nt, Artificial Sequence
  derived and/or modified CDS sequence (opt5) from DENV-1__KF184975__SS-prME
agcgugaccaugcugcucaugcugaugcccacagcgcuugcuuuccaccugacgaccagaggcggggagccucauaugaucgucuccaagcaggaacggggaaaaucucuccuguuuaagaccagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcaccggcgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugcuuaccugcgccaaguuuaagugcgugacaaaacuggagggaaagauuguucaguacgaaaaccucaaauauuccgugaucgucacggugcacaccgaggaccagcaucaaguuggcaaugaaacaaccgagcacgggacaaucgcuaccauuacgccccaggccccuaccagcgaaauccagcugacagacuacggagcccugacccucgauuguucuccccggacaggccuggacuucaacgagauggugcuucugaccaugaaggagaaauccuggcucguccauaagcagugguuucuggaucuuccucugcccuggacgagcggcgcuuccacaucucaagaaaccuggaaucgccaggaccuccuggugacauucaaaaccgcgcacgccaagaagcaggaggucgugguucuggggagccaagaaggagcuaugcacaccgcccucacaggcgccacggagauucagaccuccgggacaaccacaaucuuugcuggacaucugaaaugcagacuuaagauggauaaacugacccucaagggcaugagcuaugugauguguacggggucuuucaaacuggaaaaggaggucgccgagacacagcacggcaccgugcugguucaggugaaguacgaaggaaccgacgcgccgugcaaaauuccuuucuccauccaagaugagaagggcgucauccagaacgggcggcuuauuacagcuaaucccaucgugaccgacaaagaaaagccugugaacauugagacagagccgcccuuuggagaaagcuauaucguugucggcgccggggagaaaacgcucaagcugucuugguucaagaaaggaagcuccauuggcaagauguuugaagccaccgcuagaggggcccgccggauggcuauccugggcgauacagccugggacuucggaucuaucggcgggguguuuaccagcgugggaaaacucguccaucagguguucggcacagcguacgggguucuguuuuccggagugagcuggaccaugaagauuggcaucgggauucuucugacguggcucggccucaauucuagauccaccagccugucuaugacauguaucgccgucggaauggugacccuuuaccucggcguuauggugcaggcugauuccgggugcgucauuaacuggaaaggacgcgagcugaaguguggcagcgggaucuucgugacaaaugaaguucacaccuggacagagcaauauaaguuucaggccgacuccccuaaacggcugucugcugccauuggaaaggcgugggaggaaggcgugugcgggaucagaagcgccacccgccucgagaacgucauguggaaacagaucuccaacgaacugaaucauauucuucuggagaacgacaugaaguucacggugguggucggcgauguuaauggaauccucgcucagggcaaaaagauggugcggccgcaacccauggaacacaaauacucuuggaaaagcugggggaaggccaagauuaucggagcugacauucagaacacaaccuuuaucaucgauggcccugacacccccgaguguccugaugaccagagagccuggaauauuugggagguggaagauuauggguucggaaucuuuacaaccaacauuuggcugaagcugcgcgacuccuacacgcagaugugcgaucaccggcuuaugagcgccgcuaucaaagacucuaaggcgguccaugccgauaugggcuauuggauugaguccgagaagaaugagacauggaagcucgcuagagccagcuucaucgaagugaagaccuguaucuggcccaaaucucacacacugugguccaacggcguucuggagagcgagaugauuaucccgaagauuuacgggggaccuaccucucaacauaauuaucgccccggcuacuucacacagaccgccgggccuuggcaccucggaaaacuggaacuugacuuugaucugugcgagggcacgaccguggucguggacgaacacugcgggaaccggggacccagccucagaacaaccacaguuaccggcaagaucauucaugagugguguugccgguccuguacgcugccuccccugcgcuucaaaggcgaggacgggugcugguacggaauggaaaucagaccggugaaggagaaggaagagaaucuuguccggagcauggugucugcuggcuccggggaaguugauaacuuuagccucggacugcuguguguguccaucauggucgaggaggugaugagaucucgcuggagccggaaaaugcucaugacaggcacccuggccguguuccuucugcucauuauggggcagcugacauggaaugaccugaucagacuuugcauuauggucggagcgaacgcuuccgaucgcaugggcaugggcaccaccuaucuggcccucauggccacauuuaagaugagaccuauguucgcuguugggcugcucuuucggcgccugacgucuagagaagugcuucugcucaccaucggacugagccugguggccuccgucgagcuucccaauucucuggaagaacugggcgacgggcuggcgaugggaauuaugaugcucaaacugcuuacagauuuccaaagccaccagcuguggaccacacuccugucccugaccuuugugaagacgacacuuagccuggacuacgcuuggaaaaccauggccaugguucucucuaucgugucccuguucccccucugucugagcaccacaucucagaagaccacauggcuuccuguccugcugggcuccuuugggugcaagccgcucacgauguuccugauuaccgaaaacaaaaucuggggacggaaguccuggccccuuaacgagggcaucauggccgugggcauugcuucuauccugcucuccagccugcucaaaaaugauguuccucuggccgggccccuuauugcuggaggcaugcugaucgccuguuaugugauuuccgggagcucugcggaccugagccucgagaaggccgcugaagucuccugggaggaagaggccgaacauucuggagcuagccacaacauccugguggagguccaggaugacggcacaaugaaaaucaaggaugaggaacgcgacgauacccuuacaauucugcucaaagccacccugcucgccguguccgggguuuacccuaugucuauccccgcuacgcuguuugugugguauuucuggcaaaagaagaaacagagaagcggaguccuuugggacaccccuagcccucccgaggcggaaaaggccgugcuggacgauggcauuuaccggauccugcagcgcggccuccuggggagaucucagguuggagugggcgucuuccaagacgggguguuucauacaauguggcacgugacccggggagcuguucuuauguaucagggcaaacgcgucgagcccagcugggccuccgugaagaaagaucugauuagcuacgggggaggcuggagauuccagggccucuggaauacaggggaggaagugcaggucaucgccguggagcccggaaagaacccucggaauguucaaaccacacccggcacguuuaagaccccggaaggggaggugggagcuaucgcccuggacuucaaaccuggcacaucugggucccccauugucaacagagaaggaaagaucgugggccucuacggcaaugggguugugaccaccagcggaacauaugucucugcgauugcucaggccaaagccucccaggagggcccucugcccgagaucgaagaugagguguuucgcaagcggaaccuuacgauuauggaccugcaccccgggagcggaaaaaccagacgcuaccugccugcuaucguucgggaagccauuaagagaaagcuccgcacacugauccuugcgccgacccggguggucgcuuccgagauggccgaagcccugaaaggcaugcccaucagauaucaaacaaccgcugugaagacggagcauacagggcgcgagauuguggaucucaugugccacgccaccuucaccaugcggcugcugucuccugucagaguucccaauuacaacaugaucauuauggacgaagcucauuuuacagauccugccagcaucgcggcccggggcuauauuuccacccgcgugggaaugggcgaggcugccgcuaucuucaugacagccacacccccugggagcauggaagccuuuccgcagucuaaugcugugauccaggacgaggaaagagauauucccgagcgguccuggaacagcggauacgacuggaucacggacuucccuggcaaaacagucugguuugugcccucuauuaagagcgggaaugauaucgcgaacugucuccgcaaaaauggaaagagaguuauucagcuuucccggaagaccuucgacacagaguaucagaaaaccaagaacaacgauugggacuacguggucacgaccgauaucucugaaaugggcgccaauuucagagcugaccgcgugaucgauccucggagaugccugaaacccguuauucugaaggacgggccggagcgcgugauccucgccggcccuaugcccgucacaguggccagcgcugcccagcggagaggacgcauuggccggaaccagaauaaagaaggggaucaguacgucuauaugggacaaccccugaacaaugacgaggaucacgcgcauuggaccgaggcuaagaugcuucuggacaacaucaauacaccugaaggcauuauccccgcccucuuugagccugaaagagagaaguccgccgcuauugauggggaauaccgccugagaggagaggcccggaaaaccuucguggagcugaugcgcagaggcgaccucccgguuuggcuuucuuauaagguggcgagcgaaggguuucaguacuccgaccggcgcuggugcuucgauggcgagagaaacaaucaggugcuggaagagaacauggacgucgaaaucuggacaaaagagggagagcggaagaaacugagaccccgcuggcucgaugcccggaccuauagcgacccucuggcucuuagagaauuuaaggaguucgccgcuggccgccggucuguuuccggggaucugauccucgaaauuggaagacugccccagcaccugacgcucaaagcccaaaaugcucuugacaaccuggugaugcugcacaauagcgagcagggcgggaaggccuaccggcaugcgauggaggaacucccugauacaaucgagacccugaugcuucuggcccucauugcugugcugaccggaggcgucacacuguuuuuccucuccggcaaggggcuuggaaaaaccucuaucggccugcugugugugauggccagcuccguucuccuguggauggcuucuguggaaccccacuggauugccgccagcaucauccuugaguuuuuccugaugguccuccugauuccggaaccugaccgccagagaacaccccaggauaaccaacuggcuuauguggucaucgggcuccuuuuuauuauccugacgguggcggccaaugagaugggacugcucgagaccacaaagaaagaccugggcauugggcauguugcugccgaagaucaccagcacgccaccaugcuugacguggaucugcggccugcuuccgccuggacacucuacgcggucgccaccacgaucaucacccccaugaugcgccauacaauugagaacaccacagcuaacaucagccugaccgccauugcuaaucaggccgcgauccugaugggacucgacaagggcuggccuauuucuaaaauggacaucggcgugccccuucuggcccuggggugcuacucccaaguuaacccgcucacgcugacagcugccgugcuuaugcuggucgcucacuaugccauuaucggaccuggccuccaggcuaaggccaccagagaagcgcagaagcggacagccgcugggaucaugaaaaaucccaccguggauggaauuguggccaucgaccuggaucccguugucuacgacaccaaguucgagaaacagcugggccaaauuaugcuccuuauccuguguacaagccagauucugcucaugcgcacgaccugggcucugugcgaaucuaucacacuugccaccgggccucugacaacccucugggagggauccccgggcaaguuuuggaacacgacaaucgccgugagcauggcgaauauuuucagaggcucuuaucuggcuggggccggacuggcuuucagccucaugaaaucccuuggcgggggacggcgcggcaccggggcccagggagagacccugggcgaaaaguggaagagacagcugaaccaacucucuaaaagcgaguuuaauacauacaagcgguccggcaucaccgaaguggauagaagcgaggccaaagaagggcugaagcgcggagagacaacgaaacaugcugucucccggggcgccgcgaaacuuagaugguucguugagcgcaaccuggugaagcccgaagggaaagugauugaccucggauguggcagagggggauggucuuauuacugcgccggccugaagaaagucaccgaggugaagggcuauacaaaagggggaccuggccacgaggagcccaucccuauggcuaccuacggguggaaucugguuaagcuccauagcggaaaagauguguuuuucauucccccugaaaagugugacacacuucugugcgauaucggcgaguccucuccgaaccccaccaucgaggaagggagaacgcugcgcguccucaagaugguggagccuuggcugcggggaaaucaguuuuguauuaaaauccuuaaccccuacaugccuagcguuguggaaacccuggagcagaugcagagaaagcacggcggcaugcucguccgcaauccccugucccggaacucuacacacgagauguauugggugagcugcgggaccggaaauauuguguccgccgucaacaugacaagcagaaugcugcucaaucgcuucaccauggcucaucggaaaccgacauacgaaagagacguugaucugggcgccgggacccgccacguggcgguggagccugaagucgccaaccuugacaucauuggacaaagaaucgagaacauuaagaaugaacauaaaucuacguggcacuaugacgaggauaaccccuacaagacaugggcuuaucacggcuccuacgaggugaagcccagcgggucugccuccagcaugguuaauggagugguccggcugcucaccaaaccuugggacgugauccccaugguuacccagaucgcuaugacagauacgaccccuuuuggccagcaacgcguguucaaggaaaaagucgacacaagaaccccgcgggccaagagaggcacagcucagauuauggaggugaccgccaaauggcuguggggguuucuuucucggaacaagaagccccgcaucuguacaagagaagaguucacccggaaaguucgcuccaaugcggccauuggagcuguguuugucgaugaaaaccaguggaauagcgccaaggaggcuguggaggacgaaagauucugggaucugguccaucgggagcgcgaacuccacaaacagggcaagugcgccacgugcguguauaacaugauggggaaaagagagaagaagcugggagaauuuggcaaagccaaggggucccgggcgaucugguacauguggcugggcgcucgcuuccucgaguucgaggcccugggauuuaugaaugaagaccauugguucagcagagagaacucucuuagcggcguugaaggggagggacugcacaaacucggcuacauucugcgggauaucuccaagaucccugggggaaauauguaugccgacgauaccgcuggcugggacacacgcauuaccgaggaugaccuucaaaacgaagccaaaaucacagacauuauggagcccgaacaugcucugcucgccaccucuaucuuuaagcugacguaccagaauaaaguggucagagugcagcggccugccaagagcgggacagugauggauguuauuucccgcagagaccagcggggcucuggacaagugggcaccuaugggcugaacacauucaccaauauggagguccagcucaucagacagauggaaagcgagggaaucuuucugcccuccgagcuugaaacgccgaaccuggccgagcgcgcucucgauuggcuggaaaagcacggcguggagcggcuuaaaagaauggccauuucuggggacgauuguguugugaagccuaccgacgaucgcuucgcuacagcccugaccgcgcucaacgacaugggaaaaguccggaaggauaucccccagugggaaccuagcaaaggcuggaaugacuggcaacaggugcccuuuugcucccaccauuuccaccagcugauuaugaaggaugggagagagaucgucgugccuugucgcaaccaggacgagcugguuggccgggccagagugagccaaggagcuggcuggucucuccgcgaaacagccugccuggggaaguccuacgcucagauguggcagcuuauguauuuucaucggagagaccugcgccucgccgcuaaugccauuuguagcgcgguccccguggauuggguuccgaccucucggacaaccugguccauccacgcccaccaucaauggaugacgacagaggacaugcugagcguguggaacagagucuggaucgaagagaauccuuggauggaagauaaaacccacguguccucuugggaggacgugcccuaccuuggaaagcgggaggaucaguggugcggcagccugauugggcucaccgcuagagccacaugggccaccaacauccagguugcuauuaaucagguccgccggcugaucggaaacgaaaauuaucuggacuacaugacauccaugaaaagauucaagaacgagagcgaucccgaaggcgcccucugguga

SEQ ID NO: 18475 - RNA, 9879 nt, Artificial Sequence
  derived and/or modified CDS sequence (opt5) from DENV-1__KT831765__SS-prME
agcgugaccaugcugcucaugcugaugcccaccgcccuugcuuuccaccugacgaccagaggaggggaaccucauaugaucgucuccaagcaggaacgggggaaaucucuccuguuuaagaccagcgccggcguuaacaugugcacccuuauugcgauggaccugggggaacucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaaguucacaguuguggucggagauguggcuggcauucucgcccaggggaaaaagaugauccggccgcaacccauggagcacaaauacucuuggaaaagcuggggaaaggccaaaauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaagcugcgcgauuccuacacacagguuugcgaccaccggcuuaugagcgccgcuauuaaagauucuaaggccgugcaugccgacaugggcuauuggaucgaauccgagaaaaaugaaaccuggaagcucgcuagagccagcuucaucgaggugaagacauguauuuggcccaaaucucacacccugugguccaacgggguccuggaaagcgagaugaucauuccgaagaucuacggaggcccuauuucucaacauaaucaccgccccggguauuucacacagaccgcgggaccuuggcaccucggcaaacuggagcuugauuuugaccugugcgaagggacgaccgugguuguggaugagcauugcggaaaccggggccccagccucagaacaaccacagucaccggcaagaucauccacgaaugguguugccgguccuguacgcugccuccccugcgcuacagaggggaggacggaugcugguacggcauggagauucggccggugaaagaaaaggaggaaaaucuuguuaagagcauggugucugcuggguccggagaggucgacagcuucucccucggccugcuguguaucucuauuaugaucgaagaggugaugagaagccgcuggucccggaaaaugcucaugacagggacccuggccgucuuuuuccuucugauuaugggacagcucacauggaacgaucugaucagacugugcauuauggugggcgccaaugcuucugaccgcaugggcauggggaccaccuaucuugcccugauggcgacauuuaagaugagaccuauguucgcugucggacuccuguuucggcgccucacgagcagagaggugcugcuucugaccaucggccucucccugguggccucugucgaacugcccaacagccuugaggaacugggggauggacucgccaugggcaucaugauucugaaacuccugacagacuuccaaucccaucagcuuugggcuacccugcucagccugacauuuaucaagaccacguucucucugcacuacgccuggaaaacaauggcuaugguucuuuccauugugagccuguuuccccucugucugucuaccaccucccagaagacaaccuggcucccugugcugcuugggagccugggaugcaagccgcugacaauguuccucaucgccgagaauaaaauuuggggccggaagucuuggccccugaacgaaggcaucauggcggucgggaucguguccauucuucugagcucccuccugaaaaacgauguuccucucgccggaccccugaucgcuggcgggaugcuuauugccuguuaugugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgcgacgauacccugacaauccuucugaaagccacccuccuggcugugucuggagucuacccucucagcauucccgccacacuguuugugugguauuucuggcaaaagaagaaacagagauccggcguccuuugggacaccccuucucccccggaaguggagcgggccguucuggaugacggcaucuaccgcauuaugcagagagggcugcucggacggagccaggugggcgucgggguguuccaagaaaacguuuuucacacgauguggcaugugacccgcggagcuguccugauguaucagggcaagagacuugagccuuccugggccagcgugaaaaaggaccugaucucuuacgggggaggcuggcggcuccagggcuccuggaauacaggggaggaagugcagguuauugcggucgagcccggcaagaacccuaagaaugugcaaaccgcucccggcacauucaagaccccggaaggggaggugggagccaucgcccuggauuuuaaaccuggcacaagcgggucucccauugucaacagagaaggaaagaucgugggccucuacggcaaugggguugugacgaccuccggaacauaugucagcgcuaucgcccaggcgaaggcuucccaggagggcccucugcccgagauugaagacgagguguuccgcaagcggaaccuuaccaucauggaucugcaccccgggucuggaaaaaccagacgcuaccugccugccauuguucgggaagccaucaagagaaagcuccgcacacugauucuugcuccgacgcggguggucgccagcgagauggcugaagcccugaaaggcaugcccaucagauaucaaaccacagcggugaaguccgagcauaccgggaaagagaucguugaccucaugugccacgccacauuuaccaugcgccugcugagcccugugcggguccccaauuacaacaugauuaucauggaugaagcucauuucacggacccuucuuccauugccgcuagaggcuauaucagcacacgggugggaaugggcgaggccgccgcuauuuuuaugaccgcgacacccccugggucuguggaagccuucccgcagagcaaugcugucauccaggaugaggaacgcgacauccccgagagauccuggaacucuggauacgaguggauuacagauuuuccuggcaagaccguuugguucgugcccagcaucaaauccgggaaugacauugccaacugucuccggaagaauggaaagcgcgugauccagcuuucuagaaaaacauuugauaccgaauaucaaaagacgaaaaacaacgacugggacuacgucgugacaaccgauauuagcgagaugggcgccaauuuccgggcugacagaguuaucgauccucgccggugccugaagcccgugauucugaaagacgggccggaaagagucauccucgccggcccuaugcccgugacaguugcguccgcugcccagcgccggggaagaaucggccgcaaccacaauaaggagggggaucaguacauuuauaugggacagccccugaacaaugacgaggaucacgcccauuggaccgaagcuaagaugcuucuggacaacaucaauacgccugagggcauuauccccgcccucuucgaaccugagcgggaaaagagcgcggccauugauggggaguacagacugcgcggagaggcuagaaagaccuuuguggagcugaugcggcgcggcgaccucccggucuggcuuucuuauaaaguggccuccgagggguuccaauacagcgauagacgguggugcuuugacggcgaacgcaacaaucagguccuggaggaaaacauggauguggagaucuggacaaaggagggagaacgcaagaaacugcggcccagauggcucgacgcucgcaccuauuccgacccucuggcccuucgggaguucaaagaauuugcugccggcagacgcucuguuagcggggaucugauccucgagauuggaaagcugccccagcaccugacacagcgggcgcaaaaugcccucgacaaccuugugaugcugcauaauuccgaacagggcgggagagcuuaccggcacgccauggaggagcugccugauaccaucgaaacacucaugcugcuugcucugauugccgugcucaccggaggcgucacgcuguucuuucugucuggcaaggggcucggaaaaacaagcaucggccuucuguguguuauggccuccagcgugcugcucuggauggcuucuguggagccccacuggauugcggccuccaucauccuggaguucuuucuuaugguccugcucauuccggagccugaccgccagagaacaccccaggauaaccaacuggcuuaugugguuaucgggaugcuguucaugauucucaccguggccgccaaugagaugggacuucuggaaacaaccaagaaagaccugggcaucgggcaugucgcuguggagaaccaccaucacgccgcgaugcucgaugucgaccugcauccugccagcgcuuggacacuuuacgccguggcuacgaccauuaucacacccaugaugcggcacaccauugaaaacacaaccgccaauaucucucugacggcgaucgccaaccaggcugccauucucaugggacuggauaagggcuggccuaucuccaaaauggacauuggcguuccccugcucgcucuugggugcuacagccaggugaauccgcugacccugacagccgcuguccucaugcugguggcccacuaugcgaucauuggaccuggccuucaagccaaggcuacccgcgaggcccagaagagaacagcugccgggaucaugaaaaaccccaccguugauggaaucguggccauugaccuggaucccgucguguacgacgcgaaguuugaaaaacagcucggccagaucaugcugcugauucucuguacgucucaaauccuucugaugcggacaaccugggcucugugcgagagcauuacacucgccaccgggccucugaccacacuuugggagggauccccgggcaaguucuggaauacgaccaucgcugugucuauggccaacaucuuucgcggcagcuaucuggccggggcuggacucgccuucucccugaugaaaagccugggcgggggaagacggggcacaggggcgcagggagaaacccucggcgagaaguggaagcgccagcuuaaucagcuguccaaaucugaguucaacacauacaagagaagcggcauuauggagguugaccgguccgaagccaaagaggggcugaagagaggagagaccacgaaacaugcugucucucgcggcacagccaagcuccggugguuuguggaaagaaaucuggugaagcccgaggggaaagucaucgaucuuggauguggccgcgggggauggagcuauuacugcgcuggccugaagaaaguuaccgaagugaagggcuauaccaaagggggaccuggccacgaggaacccauuccuauggccacauacggguggaaccucgugaagcugcauuccggaaaagacgucuucuuugugcccccugagaagugugauacccugcucugcgacaucggcgagucuagcccgaaucccacaauugaagaggggcggacgcuuagaguucugaagaugguggaaccuuggcugcgcggaaaccaauucuguaucaaaauucucaaucccuacaugccuuccgucguggagacccuggagcagaugcagcggaagcacggcggcaugcuuguuagaaacccccugagccgcaauucuacacacgaaauguauuggguguccugcgggaccggaaacaucgucagcgcgaucaauaugacaucucggaugcuccugaacagauuuaccauggcccaucgcaaaccgacguacgagcgggauguggaccugggcgcugggaccagacacgugacagucgaaccugagguugccaaccucgauauuaucggacagcgcauugaaaauaucaagugugagcauaaauccaccuggcacuaugacgaggauaaccccuacaagacaugggcuuaucauggcagcuacgaagugaagcccucuggguccgccagcuccauggugaauggagucgugaaacugcuuaccaagccuugggacguuauucccauggugacacaaaucgcuaugaccgauacgacaccuuucggccagcagagagucuuuaaagagaagguggacacccggaccccgaaagccaagcgcggcacagcgcaaaucauggaaguuacggccagauggcuguggggguuccucagccggaacaagaaacccagaauuugcacccgggaggaauuuacacgcaaggugagaucuaaugcugccaucggagcugucuucguggacgagaaccaguggaauagcgccaaagaggccguugaagaugagcgguuuugggaccuggugcaccgcgaaagagagcuucacaagcagggcaaaugcgcgaccugugucuauaacaugauggggaagcgggaaaagaaacugggagaguucggcaaggcuaaagggucccgcgccauuugguacauguggcucggcgccagauuucuggaguucgaagcucugggauucaugaaugaggaucauugguuuucucgggaaaacagccucuccggcguggagggggagggacugcacaaacuuggcuacauccugcgcgacauuucuaaaaucagcgggggaaauauguaugccgaugacacagcuggcugggauaccagaaucacagaagacgaucuccagaacgaggccaagauuaccgaaaucauggagccugaacaugcgcaacuggccaaagcuauuuucaaacuuacguaccagaauaaggucgugcggguucagcgccccgccaaaaacgggaccgugauggacgucaucuccagacgggaucagcgcggcucuggacaagugggcacauaugggcugaauaccuuuacaaacauggaggcucagcucauuagacagauggagagcgaaggaaucuucuccccuagcgagcuggaaacccccaaccuggccgagcgggugcucgacuggcuggaaaaguacggcguugagagacuuaaacgcauggcgaucucuggggaugacugcguggucaagccgauugacgaucgguuugccacggcucugacagcccucaaugacaugggaaaagugagaaaggauaucccucagugggagcccuccaagggcuggaacgacuggcaacagguuccuuucuguagccaccacuuucaucagcugauuaugaaagaugggcgcgaaaucgugguccccugccggaaucaggacgagcuugugggcagagcucgcgucucucaaggagccggcuggucccugcgggaaaccgcuugucucggaaagagcuaugcccagauguggcagcugauguacuuccacagacgcgaucugcggcucgcggccaacgcuauuugcuccgccgugccuguugacugggugcccacaucuagaaccacguggagcauccaugcccaccaucaauggaugaccacagaggauaugcuguccgucuggaaucgcguguggauugaagagaacccguggauggaggacaaaacccacaucagcucuugggaagauguuccuuaucuuggaaagcgggaggaccagugguguggcucccugaucgggcucacagcuagagccaccugggcgacaaauauucagguggcuaucaaccagguccggagacugauuggaaaugaaaacuaccuugacuacaugaccagcaugaaacgcuuuaagaaugagucugaucccgagggcgcccugugguga

SEQ ID NO: 18476 - RNA, 9879 nt, Artificial Sequence
  derived and/or modified CDS sequence (opt5) from DENV-1__KP188567__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcuauucuucggaagcugugcaucgaagccaaaauuucuaauaccacgacagacucccgcuguccgacccaaggagaggcgacccucguggaagagcaggaugccaacuucgugugcagacggacauuugucgaccgcggcuggggcaauggguguggacuguucggcaaggggagccuucugaccugcgcuaaguuuaaaugcgugacaaagcucgagggaaaaaucguucaguacgaaaaccugaaguauucugugaucgucacggugcacaccggcgaucagcaucaaguugggaaugagacaaccgaacacggaacaauugccaccaucacgccccaggcuccuaccuccgagauucagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggccagcacaucccaagagaccuggaaucggcaggaucugcuggugacauucaagaccgcucacgcgaagaaacaggaagucgugguucucggaucucaagagggcgccaugcacaccgcucugacaggggccacggaaauccagaccagcggaacaaccacaauuuuugccggccaucuuaagugccgccugaaaauggacaagcucacccugaaagggauguccuaugugauguguacgggcagcuucaagcuggagaaggaagucgcugagacacagcacggaaccgugcuuguucaggugaaauacgagggcaccgaugccccgugcaagaucccuuuccucacacaagacgaaaaaggggucacccagaacggaagacugaucacagcgaaucccauugugacggauaaggagaaaccugugaacaucgaaaccgagccccccuuuggcgagucuuauauuguugucggggcuggagaaaaggcccugaagcucuccugguucaaaaagggcagcucuaucgggaaaauguuugaggccacagcucggggcgccagacgcauggcuauucugggagacaccgccugggauuucggcagcaucgggggacuuuuuacauccgugggcaagcugauccaucagguguucgggaccgcguacggaguccucuuuucuggcgugagcuggacgaugaaaauugggaucggcauucugcugaccuggcuuggacucaauucccggagcacaucucuguccaugaccuguaucgccguuggcauggugacacuguaccucggggucauggugcaggcugacagcggaugcguuauuaacuggaagggcagagaacugaagugugggucuggaaucuucgugaccaacgagguccacacauggaccgaacaauauaaauuucaggccgauuccccuaagcgccuuagcgcugccauuggcaaagcgugggaggagggggugugcggcauccgguccgccacgagacuggaaaauaucauguggaagcagauuucuaacgagcucaauuacauccugcuggaaaacgacaugaaauucacaguuguggucggagacgugaauggcauucuugcucaggggaagaaaaugaucaagccgcaacccauggagcauaaguauagcuggaaauccuggggaaaggccaaaauuaucggcgcugauauccagaacaccaccuuuauuaucgacgggccugauacacccgaauguccugacgaucagcgcgccuggaauauuugggagguggaggacuacggauucggcaucuuuaccacgaacauuuggcucaagcugcgggauucucacacacagaugugcgaccacagacugaugagcgccgcuaucaaagauuccaaggcgguccaugccgacaugggcuauuggaucgaaagcgagaagaaugaaaccuggaaacucgcucgcgccucuuucauugagguuaagacauguaucuggcccaaaucccacacccuguggagcaacggggugcuugaaucugagauggugauuccgaagaucuacggaggcccuauuucccaacauaauuaucggcccggguacuucacacagaccgccggaccuuggcaccugggcaaacucgagcuggauuuugaccugugcgaagggacgaccgucgugguugaugagcacugcggauacagaggccccagccuucgcacaaccacagugaccggcaagaucauccaugaaugguguugccggucuuguacgcucccuccccugagauuccggggggaggacggaugcugguauggcauggagauucgcccggucaaggaaaaagaggaaaaccuggugagaagcaugguuuccgcugggagcggagagguggacucuuuuucccucggcauccugugugucagcauucuuaucgaagaggugaugcgguccagauggucucgcaagaugcugaugacagggacccucgccguuuuccugcugcuuauuaugggacagcugacauggaaugaucucauccggcugugcauuauggugggcgcgaacgcucucgacagaaugggcauggggaccaccuaccuggcccuuauggccacauuuaaaaugcgcccuauguucgcugucggacugcucuuuagacggcugacgagccgcgaggugcugcuucugaccgugggccucucccuggucgccucuguugaacuccccagcucccuggaggaacuuggggauggacuggcgaugggcaucaugaugcucaagcugcugacagacuuccaaccccaccagcuuuggaccacacugcucucucugaccuuuaucagaacgagccucucccuggauuaugcuuggaaaacaauggccauggcccuuagcauugugucucuguucccucugugucucuccaccaccagccagaagacaaccuggcugccggugcuucuggggucuuuuggaugcaagccccucacaauguuccugaucacggagaauaaaauuuggggccggaaguccuggccuaucaacgaaggcauuauggcugucgggaucgugagcauccuccugucuucccuucugaaaaacgacguuccccuggccggaccucucauugcuggcgggaugcugaucgccuguuacgugauuagcggauccagcgcggaucuuucucuggagaaggccgcugaggucagcugggaagaggaagccgagcauuccggcaccucucacaauauccucguggaaguucaggacgaugggacaaugaaaauuaaggacgaggagcgcgaugacacccugacaauccuccugaaagcuacccuucuggccgugagcggagucuaucccauguccaucccugccacgcuguuugugugguacuucuggcaaaagaagaaacagagaucuggcguccucugggauacccccagcccgccugaaguggagcgggcuguucuggacgacggcauuuaucgcauccuucagagagggcugcucggacggucccaggugggcgucgggguguuccaagauggaguuuuucauacaauguggcacgugacccgcggcgcgguccugauguaccaggggaagagacucgaacccucuugggccagcgugaaaaaggaccugauuuccuacggaggcggcuggcgguuccaggggagcuggaacacaggagaggaggugcagguuaucgcugucgaaccuggcaaaaaucccaagaacgugcaaaccacaccggggacguuuaagaccccugagggagaagugggcgccauugcccuugauuucaaacccgggacaucuggauccccuaucgucaauagagagggcaagauugugggccuguaugggaacggaguugugaccaccagcggcacauacgucucugcuaucgcccaggcgaaagcuacgcaggaagggacccugcccgagaucgaggacgaaguguuuaagaaacgcaaucucacaauuauggaucugcaccccggauccggcaagacccggagauaucuuccugccaucguucgcgaggccauuaagcggaaacugagaacacucauccuggcuccgacccgcguggucgccagcgaaauggcggaggcucugaaggggaugcccauucgguaccaaacgacagccgugaaauccgaacauaccggcagagagaucguugaccucaugugccacgccaccuucacaaugcgccuucugucuccugugcggguccccaacuauaauaugaucauuauggaugaggcucauuuuaccgacccugccagcaucgcugccagaggauacauuuccacacgggugggcaugggggaagcggccgcuaucuucaugaccgccacgcccccuggaagcguggaggcuuuuccgcagucuaacgccgucauucaggaugaagagcgcgacauccccgaaagauccuggaauagcggcuaugauuggaucacagacuucccugggaagaccguuugguuugugcccucuauuaaaagcggaaacgacaucgccaauugucugcggaagaacggcaagcgcgugauucagcucuccagaaaaacauucgauaccgaguaccaaaagacgaaaaauaacgacugggauuacgucgugaccacagacaucucugagaugggggcuaacuuccgggcggauagaguuauugacccucgccggugccugaagcccgugauccuuaaagaaggcccggagagagucauucuggccggaccuaugcccgugaccguugcuagcgccgcccagcgccggggcagaaucgggcgcaaucagaacaaggaaggagaucaguauaucuacaugggccaaccccucaauaacgacgaggaucacgcucauuggacagaggccaagaugcugcuggacaauauuaacaccccugaagggaucauucccgcgcucuuugagccugaacgggagaaauccgcugccaucgauggagaauauagacuucgcggcgaggccagaaagacauucguggagcugaugcggcgcggggaccugccggucuggcucucuuacaaaguggcuagcgaaggcuuucaguauuccgauagacgguggugcuucgacggagagcgcaauaaccagguccuggaagagaauauggacguggaaauuuggaccaaggagggcgagagaaaaaagcuucggcccagauggcuggaugcccgcacguacagcgacccucucgcgcugcgggaauuuaaagaguucgccgcugggagacgcucuguuuccggagaucugauccucgaaaucggcaagcuuccccagcaccugacacugcgggcccaaaacgcucucgacaaucuggugaugcuucacaacagcgagcaggggggaaaggccuauagacaugcuauggaagagcugccugauaccauugagacccucaugcugcuggcccucaucgcggugcuuacaggcggcgucacccuguuuuuccuguccgggaaaggacucggcaagacaucuauugggcugcuuuguguuauggccagcuccgcucugcucuggauggccucuguggaaccccacuggaucgcugccagcauuauccuggaguuuuuccugauggugcuccuuaucccggaaccugaccggcagcgcacgccccaggauaaucaacuggccuacgucgugauuggacugcucuuuaugauccugaccguugcugcgaacgagaugggccuucuggagacaaccaaaaaggaccucgggauuggacauguggccgucgaaaaucaccaccaugcuacaaugcuggauguggaccugagaccugccuccgccuggacccucuacgcugucgccacgaccgugaucacacccaugaugcggcacaccauugagaacacaaccgcgaacaucagccuuacggccauugcuaaucaggccgcuauccugaugggccuggauaaaggcuggccuaucucuaagauggacauugggguuccccuccuggcccuuggaugcuauucccaggugaacccgcugacacucaccgcggccguccugaugcugguggcucauuacgccaucauuggcccugggcuccaagcuaaggccacacgcgaagcucagaaaagaaccgccgcgggaaucaugaagaaucccaccguugauggcauugugacaaucgaccuugaccccgucguguaugaugccaaauucgagaagcagcuggggcagaucaugcugcucauucuguguacgagccaaauccuucugaugcggaccacaugggcucucugcgaaucuauuacccuggccacaggaccucugaccacgcucugggagggcuccccgggcaaauuuuggaacacaaccaucgcugugagcauggccaauauuuuccgcgggucuuaccuugccggagcgggccuggcuuucagccugaugaagucccucgggggaggcagacgggggaccggagcccagggcgagacacugggcgaaaaguggaaacgccagcuuaaccagcugucuaagagcgaguuuaauaccuauaaaaaguccgggaucauggaaguugacagaagcgaggcuaaagaaggacucaagcggggcgagacaacgaagcacgccgucuccagagggaccgccaaacugcgcugguucguggagcggaaccuggugaagcccgaaggaaaagucaucgaucucggcugugggagaggaggcuggucuuacuauugcgcuggccuuaagaaaguuacagaggugaagggguacaccaaaggaggcccugggcaugaagagcccauuccuauggccacauacggauggaaucuggugaagcugcacagcggcaaggacgucuuuuucacccccccugaaaaaugugauacgcuccugugcgacaucggggaguccucuccgaaccccaccauugaggaaggacgcacacuucgggugcugaagaugguugagccuuggcucagaggcaaucaauuuuguaucaaaauucugaaccccuauaugccuagcguggucgaaacccuggagcagaugcagcgcaagcacggcgggaugcucgugcggaauccccuguccagaaacucuacacaugagauguacuggguuagcugcggaaccggcaauaucguguccgcggucaacaugacaagccgcaugcuucugaaucgguucaccauggcccacagaaaaccgacguaugaacgcgauguggaccucggggcuggaacacggcauguggccgucgagccugaaguugcuaaccuggauauuaucggccagagaaucgagaacauuaagaaugaacacaagucuaccuggcacuacgacgaggauaaccccuauaaaaccugggccuaccauggguccuaugaggugaagcccagcggaucugcguccagcauggugaauggcgucgugcgccuucugacaaaaccuugggacguuauccccauggugacgcaaauugccaugaccgacacaaccccuuuuggccagcagagagucuucaaggaaaaaguggauacacggaccccgcgcgcuaagagagggacagcccaaaucauggagguuaccgcuaaguggcucuggggauuucugucucggaacaaaaagcccagaauuuguacgcgggaagaguucacccgcaaagugagauccaaugccgcuaucggcgccgucuuuguggacgaaaaccaguggaauagcgcgaaggaggccguugaggaugaacgguucugggaccuggugcaccgcgagagagaacuccauaaacaggggaagugcgcuacaugcgucuacaacaugaugggaaagcgggagaaaaagcugggcgaauuugggaaagccaagggcucccgcgcuaucugguacauguggcuuggagccagauuccuggaguucgaggcccucggcuuuaugaaugaagaucacugguucagccgggagaacucucugagcgggguggaaggagagggccuucauaaacugggguauauucuccgcgacaucuccaagauuccuggaggcaauauguacgcggaugacaccgcugggugggauacaagaaucaccgaggacgaucugcagaacgaagccaaaauuacggacaucauggagcccgaacacgcccugcucgcuacaucuaucuuuaagcugaccuaucaaaauaaggucgugcggguucagcgcccugccaaaagcggcacagugauggaugucauuuccagacgggaccagcgcggaucuggccagguggggaccuacggacuuaacacguucaccaauauggaggugcaacugaucagacagauggaaagcgagggcauuuuuucccccucugagcucgaaacaccgaaccuggcuaagaaaguucuugacuggcuggagaagcacggggccgaacggcucaaaagaauggcgaucagcggagaugacuguguggucaagccuauugaugaccgcuucgccaccgcucugacagcccugaacgauaugggcaaggugcggaaagacaucccccagugggagccuuccaagggguggaaugauuggcagcaaguucccuuuugcagccaucacuuccaucagcucaucaugaaagacggcagagaaauuguggucccuugucgcaaccaggaugagcuggugggacgggcuagagucucucagggcgccggguggucccuucgcgagaccgcgugccugggaaagagcuaugcccaaauguggcagcucauguacuuucaccggagagaccugcgccuugcugccaaugcuaucuguucugccgugcccgcugauuggguuccgacaucccggaccacguggagcauucacgcccaucaccaguggaugacaaccgaagacaugcuguccguguggaacagagucuggaucgaggaaaauccuuggauggaggacaaaacccaugugucuagcugggaagagguucccuaucucggcaagcgcgaggaucaauggugcgggucccugauuggacugacagcgcgggccaccugggcuacaaacauccagguggccauuaaucaggucagacggcucaucggcaacgaaaauuaccuggacuacaugacgagcaugaagagauucaaaaacgagucugaucccgaaggggcccuuugguga

SEQ ID NO: 18477 - RNA, 9879 nt, Artificial Sequence
  derived and/or modified CDS sequence (opt5) from DENV-1__KP188568__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaaucauauucugcuggaaaacgacaugaaauucacaguggucgugggagacgugaauggcauccuugcucaggggaagaaaaugauucgcccgcaacccauggagcacaaguacagcuggaaguccuggggaaaagccaagaucauuggcgcugauauccagaacaccaccuuuaucauugacgggccugauacacccgaauguccugacgaucagcgggccuggaauaucugggaggucgaggacuauggauucggcauuuuuaccacgaacaucuggcucaaacugagagauucucacacacagaugugcgaccaucgccugaugagcgccgcuauuaaggauuccaaagcgguucacgccgacaugggcuacuggaucgaaagcgagaagaaugaaaccuggaagcucgcucgggccucuuucaucgaggugaaaacauguauuuggcccaagucccauacccuguggagcaacggggugcuugaaucugagauggucaucccgaaaauuuauggaggcccuaucucccaacacaauuacagacccggguauuucacacagaccgccggaccuuggcaccugggcaagcucgagcuggauuuugaccugugcgaagggacgaccgugguuguggaugagcauugcggauaccgcggccccagccuucggacaaccacagucaccggcaaaauuauccacgaaugguguugcagaucuuguacgcucccuccccugcgguuccgcggggaggacggaugcugguacggcauggagaucagaccggugaaggaaaaggaggaaaaccugguucggagcaugguguccgcugggagcggagagauggacucuuuuucccucggcauucugugugucagcauccuuauugaagaggugaugagaucccgcuggucucggaaaaugcugaugacagggacccucgccguuuucuuucugcugaucaugggacagcuuacauggaaugaucugauuagacucugcaucauggugggcgcgaacgcuagcgaccgcaugggcauggggaccaccuaucuggcccucauggccacauucaagaugagaccuauguuugcugucggacugcuuuuccggcgccugacguccagagaggugcuccugcugaccgugggccuuucucuggucgccagcguugaacuccccaauucccuggaggaacucggggauggacuggcgaugggcauuaugaugcuuaaacugcucacagacuuucaaccccaucagcuguggaccacacugcuuucucugaccuucauccggacgagccucucccuggauuacgcuuggaagacaauggccauggcccucagcaucgugucucuguuuccucuuugucuguccaccaccagccagaaaacaaccuggcugccggugcuccuggggucuuucggaugcaagccccuuacaauguuucugauuacggagaacaagaucuggggccgcaaauccuggccuauuaacgaaggcaucauggcugucgggauugugagcauccuccugucuucccuccugaagaaugacguuccccuugccggaccucugaucgcuggcgggaugcugauugccuguuaugugaucagcggauccagcgcggaucucucucuggagaaagccgcugaggucagcugggaagaggaagccgagcacuccggcaccucucauaacauucuuguggaaguucaggacgaugggacaaugaagaucaaagacgaggagagagaugacacccugacaauucuccugaaggcuacccuccuggccgugagcggagucuaccccauguccaucccugccacgcuuuucgugugguauuucuggcaaaaaaagaagcagcggucuggcguccugugggauacccccagcccgccugaaguggagcgcgcuguucuggacgacggcaucuacagaauucuccagcgggggcugcuuggacgcucccaggugggcgucgggguguuucaagauggaguuuuccacacaauguggcacgugaccagaggcgcgguccugauguaucaggggaaacggcucgaacccucuugggccagcgugaagaaagaccugaucuccuacggaggcggcuggagauuucaggggagcuggaauacaggagaggaggugcagguuauugcugucgaaccuggcaagaaccccaaaaaugugcaaaccacaccggggacguucaagaccccugagggagaagugggcgccaucgcccucgauuuuaagcccgggacaucuggauccccuauugucaaccgcgagggcaaaaucgugggccuguacgggaauggaguugugaccaccagcggcacauaugucucugcuauugcccaggcgaaggcuacgcaggaagggccccuucccgagaucgaggacgaaguguucaaaaagcggaaccugaccaucauggaucugcauccuggauccggcaaaacaagacgcuaccucccgagcauuguucgggaggccaucaagagaaagcugcgcacccuuauucuggcccccacacggguggucgcuuccgaaauggccgaggcgcucaaagggaugccuaucagauaucaaaccacggcugugaagucugaacacacaggccgcgagauuguugaccugaugugccaugccaccuuuaccaugcggcugcucagccccgugagagucccuaauuacaacaugaucaucauggaugaggcccacuucacagaccccgcuuccauugccgcucggggauauaucagcacccgcgugggcaugggggaagccgcggccauuuuuaugacagcuaccccuccgggaucuguggaggccuucccccaguccaaugcugccauccaggaugaagagagagacauuccugaacggagcuggaacacgggcuacgauuggaucacagacuuucccgggaaaaccgucugguucguuccuucuaucaagagcggaaaugacauugccaacugucuucgcaaaaauggcaagagagugauccagcugucccggaagacauucgauaccgaguaucaaaaaacgaagaacaacgacugggauuacguggucaccacagacauuucugagaugggggcuaauuuuagagcggaucgcgugaucgacccccggagaugccugaaaccgguuauucucaaggaaggcccugagcgcgugauccuggccggacccaugcccgucaccguggcuagcgccgcccagcggagaggccgcauugggcggaaccagaauaaagaaggagaucaguacaucuauaugggccaaccucuuaacaaugacgaggaucaugcucacuggacagaggccaagaugcugcucgacaacaucaauacccccgaagggauuaucccugcgcuguucgagccggaaagagagaaguccgcugccauugauggagaauaccgccugagaggcgaggcccggaaaacauuuguugagcucaugcgcagaggggaccuucccguguggcugucuuauaaggucgcuagcgaaggcuuccaguacuccgaucggcgcuggugcuuugacggagagagaaacaaucaggugcuggaagagaacauggacgucgaaaucuggaccaaagagggcgagcggaagaaacucagaccucgcuggcuggaugcccggacguauagcgacccccuugcgcugagagaauucaaggaguuugccgcugggcgccggucuguguccggagaucucauucuggaaaucggcaaacugccucagcaccucacacuuagagcccaaaaugcucuggacaaccugguuaugcuccauaauagcgagcaggggggaaaggccuaccggcacgcuauggaagagcugcccgauaccaucgagacccuuaugcugcucgcccugauugcggugcugacaggcggcgugacccucuucuuucuuuccgggaagggacugggcaaaacaucuaucgggcugcucugugucauggccagcuccgcucugcuuuggguugccucuguggaaccgcauuggauugcugccagcaucauucuggaguucuuucucauggugcugcugaucccugaacccgaccgccagagaacgccucaggauaaccaacucgccuaugucgugaucggacuucuguucaugauucugaccguugcugcgaaugagaugggccuccuggagacaaccaagaaagaccuugggaucggacacguggccgucgaaaaccaccaucacgcuacaaugcuggauguggaccuccggcccgccuccgccuggacccuguacgcugucgccacgaccgugauuacaccuaugaugcgccauaccaucgagaacacaaccgcgaauauuagccugacggccaucgcuaaccaggccgcuauucucaugggccuugauaagggcuggcccaucucuaaaauggacaucgggguuccgcugcuggcccucggaugcuacucccaggugaauccucugacacuuaccgcggccguccugaugcucguggcucacuaugccauuaucggccccgggcugcaagcuaaggccacaagagaagcucagaagcggaccgccgcgggaauuaugaaaaaccccaccguugauggcaucgugacaauugaccuggacccugucguguacgaugccaaguuugagaaacagcucgggcagaucaugcuucugauccuguguacgagccaaauucuccugaugcgcaccacaugggcucuuugcgaaucuaucacccuggccacaggaccgcucaccacgcugugggagggcucccccggcaaguucuggaauacaaccauugcugugagcauggccaacaucuucagagggucuuaucuggccggagcgggccucgcuuuuagcguuaugaaaucccuugggggaggccggcgcgggaccggagcccagggcgagacacugggcgaaaaguggaagagacagcugaaucagcucucuaaaagcgaguucaacaccuacaagaaauccgggauuauggaagucgaccggagcgaggcuaaggaaggacugaaaagaggcgagacaacgaagcaugccgugucccgcgggaccgccaagcuucggugguuuguggagagaaaucuggucaaaccugaaggaaagguuaucgaucucggcugugggcgcggaggcuggucuuauuacugcgcuggccugaaaaaggugacagaggugaaaggguauaccaagggaggccccgggcacgaagagccuauccccauggccacauacggauggaaccuggucaaacuccacagcggcaaggacguguucuuuaccccuccggaaaagugugauacgcuucugugcgacauuggggaguccucucccaauccuaccaucgaggaaggacggacacugagaguucucaaaaugguggagcccuggcugcgcggcaaccaauucuguauuaagauccuuaauccuuacaugcccagcgucguggaaacccuggagcagaugcagcggaaacauggcgggaugcucguuagaaacccgcugucccgcaauucuacacacgagauguauugggugagcugcggaaccggcaacauugucuccgcggugaauaugacaagccggaugcugcucaacagauuuaccauggcccaucgcaagccuacguacgaacgggauguggaccugggggcuggaacaagacacgucgccguugagcccgaaguggcuaaccuugauaucauuggccagcgcaucgagaauaucaaaaacgaacacaagucuaccuggcauuaugacgaggauaaucccuacaagaccugggccuaucacggguccuacgaggugaaaccuagcggaucugcguccagcauggucaacggcgugguuagacugcucacaaagcccugggacgugauuccuauggucacgcaaaucgccaugaccgacacaaccccguucggccagcagcggguguuuaaagaaaagguugauacacgcacccccagagcuaaacgggggacagcccaaauuauggaggugaccgcuaaguggcuguggggauuccuuucuagaaauaagaaaccucggaucuguacgcgcgaagaguuuaccagaaagguccgguccaacgccgcuauuggcgccguguucguugacgaaaaucaguggaacagcgcgaaagaggccguggaggaugaacgcuuuugggaccugguccauagagagcgggaacuccacaagcaggggaaaugcgcuacaugcguguauaauaugaugggaaagcgcgagaagaaacugggcgaauucgggaaggccaaaggcuccagagcuaucugguacauguggcugggagcccgguuccucgaguuugaggcccugggcuucaugaacgaagaucauugguuuagccgcgagaauucucuuagcggggucgaaggagagggccugcacaagcucggguacauccugagagacauuuccaaaauccccggaggcaacauguaugcggaugacaccgcugggugggauacacggauuaccgaggacgaucuucagaaugaagccaagaucacggacauuauggagccugaacacgcccugcucgcuacaucuaucuucaaacugaccuaccaaaacaaggugguucgcgugcagagacccgccaagagcggcacagucauggaugugaucucccggcgcgaccagagaggaucuggccagguggggaccuauggacugaauacguuuaccaacauggagguucaacucauucggcagauggaaagcgagggcaucuucuccccgucugagcuggaaacaccuaaccuugcuaaaaaggugcuggacuggcucgagaaacauggggccgaaagacugaagcgcauggcgauuagcggagaugacugugucgugaaacccaucgaugaccgguuugccaccgcucuuacagcccugaaugauaugggcaagguuagaaaggacauuccucagugggagcccuccaaaggguggaacgauuggcagcaagugccuuucugcagccaccauuuucaccagcucaucaugaaggacggccgcgaaaucgucgugcccugucggaaucaggaugagcuggucggaagagcucgcgugucucagggcgccggguggucccugcgggagaccgcgugccucggaaaaagcuacgcccaaauguggcagcugauguauuuccacagacgcgaccuucggcuggcugccaacgcuauuuguucugccguuccgguggauugggucccuacauccagaaccacguggagcauccaugcucaccaucaguggaugacaaccgaagacaugcucuccguguggaaucgcguuuggauugaggaaaaccccuggauggaggacaagacccacgugucuagcugggaagagguccccuaccugggcaaacgggaggaucaauggugcgggucccuuaucggacugacagccagagcgaccugggccacaaauauucagguggcuaucaaccaggugcggagacucauuggcaaugaaaacuaucuggacuacaugacgagcaugaagcgcuuuaagaaugagucugauccugaaggggcccugugguga

SEQ ID NO: 18478 - RNA, 9879 nt, Artificial Sequence
  derived and/or modified CDS sequence (opt5) from DENV-1__KF971870__SS-prME
agcgugaccaugcugcucaugcugaugcccaccgcccuugcuuuccaccugacgaccagaggaggggagccucauaugaugguguccaagcaggaacggggaaaaucucuccuguuuaagaccagcgccggcguuaacaugugcacccuuaucgcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauccagcggguugaaacaugggcucugcgccaccccggcuucaccgugaucgcccuuuuucuggcgcaugccaucgggacaucuauuacccagaagggaaucaucuucauucuccugaugcuugucaccccuagcauggcuaugagaugcgugggcaucgggucccgggauuuuguugagggacugagcggcgccacauggguggacgucgugcucgagcacgggucuugugugacgaccauggcuaaggauaaacccacacuggacauugaacugcucaagaccgaggucacaaacccugccguucugcgcaaacuuugcaucgaagcgaagauuuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagauuguucaguacgaaaaccugaaauauuccgugaucgucacggugcacaccggcgaccagcaucaaguugggaaugagagcacagaacacggaaccacagcuaccaucacgccccaggccccuaccacagagauucagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauccagacauccggaaccacaaccauuuuugcuggccaucucaaaugcagacugaagauggauaaacuuacgcugaaggggaugagcuaugugauguguacaggcucuuucaaacucgagaaggaagucgccgagacccagcacggaaccgugcugguucagaucaaguacgagggcacagacgcgccgugcaaaauuccuuucuccacccaagaugaaaagggggugacacagaacggacggcugaucacggcuaaucccaucgucaccgacaaagagaagccugugaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauucugggagauaccgccugggacuucggcucuaucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggcuggcauccucgcccaggggaaaaagaugauucggccgcaacccauggaguacaaauauucuuggaaaagcuggggaaaggccaagaucauuggcgcugacgugcagaauaccaccuuuaucaucgaugggccuaacacacccgaauguccugacgaucagagagcguggaauauuugggaggucgaggacuacggauucggcaucuuuaccacgaacauuuggcugaagcugcgcgauuccuauacacagguuugcgaccaccggcuuaugagcucugccaucaaagauuccaaggcugugcacgccgacaugggcuacuggauugaaagcgagaaaaaugauaccuggaagcucgccagagcuucuuucaucgaagugaagacauguaucuggcccaaaucccauacccuguggagcaacgggguccuggagucugaaaugauuaucccgaagauuuauggaggcccuaucagccaacacaauuaccgccccggguacuucacacagaccgccggaccuuggcaucucggcaaacuggagcuugacuuugaucugugcgaggggacgaccgugguuguggacgaacacugcggaaaccggggccccucccucagaacaaccacagucaccggcaagauuauccacgagugguguugccggagcuguacgcugccuccccugcgcuucagaggggaagacggaugcugguauggcauggagauccggccggugaaagagaaggaagagaaucuuguuaagucuaugguguccgcggggagcggagaagucgauuccuuuucucucggccugcuguguauuagcaucaugauugaggaagugaugagaucccgcuggucucggaaaaugcucaugaucgggacacuggcuguuuucuuucuucugauuaugggacagcucaccuggaacgaccugaucagacugugcauuauggugggcgccaaugccagcgaucgcaugggcauggggacaaccuaccuugcucugauggccaccuucaagaugagaccuauguuugcggucggacuccuguuccggcgccucacauccagagaggugcugcuucugacgaucggccucucucugguggcuagcgccgagcugcccaacucccuugaagaacugggggacggacucgccaugggcaucaugauucugaaacuccugaccgauuuucaaagccaucagcuuugggcuacacugcucucucugaccuucaucaagacaaccuuuucccugcacuaugccuggaaaacgauggcuaugguccuuagcauuguuucucuguucccccucugucuguccacaaccagccagaagaccacauggcucccugugcugcuugggucucugggaugcaagccgcugaccauguuucucaucgccgaaaauaaaauuuggggccggaaguccuggccccugaacgagggcaucauggcgguggggaucgucagcauucuucuguccagccuccugaaaaacgacgugccucucgccggaccccugaucgcuggcgggaugcuuauugccuguuacguuaucucuggaagcuccgcugaucugucucuggaaaaggccgccgaggugagcugggaggaagaggcugaacauuccggcgcgucucacaauauucucgucgaggugcaggacgaugggacaaugaaaaucaaggacgaagaacgcgaugacacgcugaccauccuucugaaagccacacuccuggcuguuagcggaguguucccucucuccauucccgccacccuguucgucugguauuuuuggcaaaagaagaaacagagaucuggcgugcuuugggauacaccuagcccucccgaggucgaacgggccgugcuggacgacggcaucuaccgcauuaugcagagagggcugcucggacggucccagguuggcgugggggucuuccaagagaacguguuucauaccauguggcacguuacgcgcggagcugugcugauguaucagggcaagagacuugaacccagcugggccucugucaaaaaggaucugaucuccuacgggggaggcuggcggcuccagggcagcuggaauaccggggaggagguccaggugauugcgguugaacccggcaaaaauccuaagaauguccaaacagcucccggcaccuucaagacaccggagggggaagugggagccaucgcccuggacuuuaaaccuggcaccucugggucccccauugugaacagagagggaaagaucgucggccucuacggcaauggggugguuacaacgagcggaaccuauguguccgcuaucgcccaggcgaaggcuucucaggaaggcccucugcccgagauugaggaugaagucuuccgcaagcggaaccuuacaaucauggaccugcaccccgggagcggaaaaaccagacgcuaccugccugccauugugcgggaggccaucaagagaaagcuccgcacccugauucuugcuccgacacggguuguggccuccgaaauggcugaggcccugaaaggcaugcccaucagauaucaaacgaccgcggucaagagcgaacauacagggaaagagaucguggaucucaugugccacgccaccuuuacaaugcgccugcugucuccuguucgggugcccaauuacaacaugauuaucauggacgaggcucauuucaccgauccuuccagcauugccgcuagaggcuauaucucuacgcgggucggaaugggcgaagccgccgcuauuuuuaugacagcgacacccccugggagcguggaggccuucccgcaguccaaugcugugauccaggacgaggaacgcgauauccccgaaagaucuuggaacagcggauacgaguggauuaccgacuuuccuggcaagacagucugguucguucccuccaucaaaucugggaaugauauugccaacugucuccggaagaauggaaagcgcgugauccagcuuagcagaaaaaccuucgacacagaguaucaaaagaccaaaaacaacgacugggauuacguggucacgacagacauuuccgaaaugggcgccaauuuucgggcugauagagugaucgacccucgccggugccugaagcccguuauucugaaagaugggccggagagagugauccucgccggcccuaugcccgucaccguggcgagcgcugcccagcgccggggaagaaucggccgcaaccacaauaaggaaggggaccaguacauuuauaugggacagccccugaacaaugaugaggaccaugcccacuggacagaggcuaagaugcuucuggauaacaucaauaccccugaaggcauuauccccgcccucuucgagccugaacgggagaaaucugcggccauugacggggaauacagacugcgcggagaggcuagaaagacguuuguugagcugaugcggcgcggcgaucucccgguguggcuuuccuauaaagucgccagcgaaggguuccaauacuccgacagacgguggugcuuugauggcgagcgcaacaaucaggugcuggaagagaacauggacgucgaaaucuggaccaaggagggagagagagaaaaacugcggcccagauggcucggcgcucgcacauauucugacccucuggcccuucgggauuucaaggaguuugcugccgggagacgcagcguguccggagaccugauccucgaaauuggcaaacugccccagcaccugacccagcgggcgcaaaaugcccucgauaaccuuguuaugcugcauaauucucagcaagggggacgggcuuacacacacgccauggaggaacugccugacaccaucgagacacucaugcugcuugcucugauugccgugcucaccggcggcgugacgcuguucuuucugagcgggcggggacucggcaagacauccaucgggcuucugugugucauggccagcucuguucugcucuggauggcuuccguggagccccauuggauugcggccagcaucauccuggaguucuuucuuauggugcugcucauuccggagccugaucgccagagaacaccccaggacaaccagcuggcuuaugucgugaucggacuccuguucaugauucuuaccguugccgccaaugaaaugggccugcuggagacaaccaagaaagaucucgggaucggacacguggcugucgagaaccaccaucacgccgcgaugcuggacguggaucuucauccugccucugcuuggacacuguacgccgucgcuacgaccauuaucacacccaugaugcggcacaccauugaaaacacaaccgccaauaucucccucacggcgaucgccaaccaggcugccauucugaugggccuggacaagggcuggccuaucagcaaaauggauauuggggugccccuccuugcucugggaugcuacucucaaguuaauccgcugacccucacagccgcugugcugaugcuugucgcccauuaugcgaucauuggcccugggcugcaggccaaggcuacccgcgaggcccagaaaagaacagcugccggaaucaugaagaaccccaccguggacggcaucguugccauugaucucgaccccguggucuacgacgcgaaguuugaaaaacagcuggggcaaaucaugcugcucauucuuuguacgagccagauccugcugaugcggacaaccugggcucucugcgaguccauuacacuggccaccggaccucuuaccacacugugggaaggcucuccgggcaaguucuggaauacgaccaucgcugugagcauggccaacaucuuccgcggguccuaucucgccggagcuggccuggccuuuagccugaugaaaucccucgggggaggcagacgggggacaggagcgcagggcgagacccuuggcgagaaguggaaacgcagacugaaucagcugucuaagagcgaguucaacacauacaagcgguccgggauuauggagguggauagaucugaagccaaagagggacucaagcgcggcgaaaccacgaaacacgcuguuagccgggggacagccaagcugagaugguuugucgagcgcaaucuugugaaacccgagggaaaggugaucgaccugggcugugggcggggaggcugguccuauuacugcgcuggccucaagaaagucaccgaaguuaagggguauaccaaaggaggcccugggcacgaggaacccauuccuauggccacauacggauggaaccuggugaagcugcauucuggcaaagauguguucuuuauucccccugagaagugugacacccuccuuugcgauauuggggaaagcuccccgaaucccacaaucgaggagggaagaacgcugcgcguccugaaaaugguggaaccuuggcuccggggcaaccaauucuguauuaagauccugaaucccuacaugccuagcguuguggagacccuugaacagaugcagagaaagcacggcgggaugcugguccgcaacccccucucuagaaauuccacacaugagauguauugggugagcugcggaaccggcaacaucguuucugcggugaauaugacauccagaaugcugcugaaccgcuuuaccauggcccaccggaaaccgacguacgagagagacgucgaucucggggcuggaacccgccacguggccguggaaccugaggucgcuaaccuggacauuaucggccagagaauugaaaauaucaagcaugagcacaaaagcacauggcauuaugaugaagacaaccccuacaagaccugggccuaucacgggucuuacgagguuaaacccuccggaagcgcuuccagcauggugaauggcguggucaaacuucugacaaagccuugggaugugauucccaugguuacccaaaucgccaugacagacaccacgccuuucggccagcagcggguguuuaaagagaaggucgacacacgcaccccgaaagcgaagagagggaccgcccaaaucauggaagugacagcucgguggcucuggggauuccugucuagaaacaaaaagccccggauuuguacgcgcgaggaauuuaccagaaagguucggagcaaugccgcuaucggcgccguguucauugaugagaaccaguggaacuccgccaaagaagcggucgaggacgagcgcuuuugggaucuugugcauagagaacgggagcugcacaagcaggggaaaugcgcuacaugcguuuauaacaugaugggaaagcgcgagaaaaagcucggcgaguucgggaaggccaaaggcucuagagccaucugguacauguggcugggagcucgguuccuggaauuugaggcccucggcuucaugaaugaggaccacugguuuagccgcgaaaacucccugucugggguggagggagaaggccuucauaagcugggguacauucucagagauaucagcaaaaucccuggaggcaauauguaugcugacgauaccgccgggugggacacacggauuaccgaggaugaccugcagaacgaggcgaagaucacagauauuauggaacccgagcacgcccuucuggcuaaagccaucuucaagcucaccuaccaaaauaaagucgugcgcguccagagaccugcuaagaacggcacggugauggacguuauuucccggcgcgaucagagaggaucuggccagguggggaccuauggacugaauacauuuaccaacauggaagcccaacugauccggcagauggagagcgaaggcaucuucucccccagcgagcucgagacaccgaaccuggcggaaagaguccuugacuggcuggggaaguacggaguggagcgccucaaacggauggccauuucuggcgacgauugugugguuaagccuaucgacgauagauuugcuaccgcccugacggcucuuaaugacauggggaaagugcgcaaggauauuccccagugggaaccuuccaaaggcuggaacgacuggcagcaaguccccuucugcagccaucacuuucaccagcugaucaugaaggauggacgggagauugugguuccuuguagaaaucaggacgaacucgugggccgcgcccgggucucucagggggcuggauggucccugagagagacagccugccugggcaagagcuaugcgcaaauguggcagcucauguacuuccaucgccgggaucugagacuugccgcuaacgccaucuguuccgccgugcccgucgacugggugccgaccucucgcacaaccuggagcauucacgcucaucaccaguggaugacgaccgaggauaugcuguccguuuggaaucggguguggaucgaagagaacccuuggauggaagacaaaacacauaucagcaauugggaggacguccccuaucucgggaagagagaagaucaauggugcggaucucugauuggccuuaccgcccgggcgacaugggcuaccaacauccagguggccauuaaucagguuagacgccugaucgggaacgagaauuaccucgacuacaugacauccaugaaacgguuuaagaacgagagcgaucccgaaggcgcccugugguga

SEQ ID NO: 18479 - RNA, 9879 nt, Artificial Sequence
  derived and/or modified CDS sequence (opt5) from DENV-1__KF971871__SS-prME
agcgugaccaugcugcucaugcugaugcccacagcucuugcuuuccaccugacgaccagaggaggggagccucauaugaugguguccaagcaggaacggggaaaaucucuccuguuuaagaccagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauccagcggguugaaacaugggcucugcgccaccccggcuucaccgugauugcccuuuuucuggcgcaugccaucgggacaucuauuacccagaagggaaucaucuucauucuccugaugcuugucaccccuagcauggcuaugagaugcgugggcaucgggucccgggauuuuguugagggacugagcggcgccacauggguggacgucgugcucgagcacgggucuugugugacgaccauggcuaaggauaaacccacacuggacauugaacugcucaagaccgaggucacaaacccugccguucugcgcaaacuuugcaucgaagcgaagauuuccaauaccacgacagauagcagauguccgacccaaggagaggccacccugguggaagaacaggacgcuaacuucgugugccggcgcacauuugucgauagaggcuggggcaauggguguggacucuucggcaaagggucucugaucacaugcgccaaguuuaagugcgugacaaaacuugagggaaagauuguucaguacgaaaaccugaaauauuccgugaucgucacggugcacaccggcgaccagcaucaaguugggaaugagagcacagaacacggaaccacagcuaccaucacgccccaggccccuaccacagagauucagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauccagacauccggaaccacaaccauuuuugcuggccaucucaaaugcagacugaagauggauaaacuuacgcugaaggggaugagcuaugugauguguacaggcucuuucaaacucgagaaggaagucgccgagacccagcacggaaccgugcugguucagaucaaguacgagggcacagacgcgccgugcaaaauuccuuucuccacccaagaugaaaagggggugacacagaacggacggcugaucacggcuaaucccaucgucaccgacaaagagaagccugugaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauucugggagauaccgccugggacuucggcucuaucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggcuggcauccucgcccaggggaaaaagaugauucggccgcaacccauggaguacaaauauucuuggaaaagcuggggaaaggccaagaucauuggcgcugacgugcagaauaccaccuuuaucaucgaugggccuaacacacccgaauguccugacgaucagagagcguggaauauuugggaggucgaggacuacggauucggcaucuuuaccacgaacauuuggcugaagcugcgcgauuccuauacacagguuugcgaccaccggcuuaugagcgccgcuaucaaagauucuaaggccgugcacgccgacaugggcuacuggauugaauccgagaaaaaugauaccuggaagcucgcuagagccagcuucaucgaagugaagacauguaucuggcccaaaucucauacccugugguccaacgggguccuggagagcgaaaugauuaucccgaagauuuauggaggcccuaucucucaacacaauuaccgccccggguacuucacacagaccgcgggaccuuggcaucucggcaaacuggagcuugacuuugaucugugcgaggggacgaccgugguuguggacgaacacugcggaaaccggggccccagccucagaacaaccacagucaccggcaagauuauccacgagugguguugccgguccuguacgcugccuccccugcgcuucagaggggaagacggaugcugguauggcauggagauccggccggugaaagagaaggaagagaaucuuguuaagagcauggugucugcuggguccggagaagucgauagcuuuucccucggccugcuguguauuucuaucaugauugaggaagugaugagaagccgcuggucccggaaaaugcucaugaucgggacacuggccguuuucuuucuucugauuaugggacagcucaccuggaacgaccugaucagacugugcauuauggugggcgccaaugcuucugaucgcaugggcauggggacaaccuaccuugcccugauggcgaccuucaagaugagaccuauguuugcugucggacuccuguuccggcgccucacaagcagagaggugcugcuucugacgaucggccucucccugguggccucugccgagcugcccaacagccuugaagaacugggggacggacucgcuaugggcaucaugauucugaaacuccugaccgauuuucaaucccaucagcuuugggccacacugcucagccugaccuucaucaagacaaccuuuucucugcacuaugcuuggaaaacgauggccaugguccuuuccauuguuagccuguucccccucugucugucuacaaccucccagaagaccacauggcucccugugcugcuugggagccugggaugcaagccgcugaccauguuucucaucgcggaaaauaaaauuuggggccggaagucuuggccccugaacgagggcaucauggccguggggaucgucuccauucuucugagcucccuccugaaaaacgacgugccucucgcuggaccccugaucgccggcgggaugcuuauugcuuguuacguuaucagcggaucuagcgccgaucugucccuggaaaaggccgcugaggugucuugggaggaagaggcggaacauagcggcgccucccacaauauucucgucgaggugcaggacgaugggacaaugaaaaucaaggacgaagaaagagaugacacgcugaccauccuucugaaagcuacacuccuggccguuucuggaguguucccucucagcauucccgccacccuguucgucugguauuuuuggcaaaagaagaaacagagauccggcgugcuuugggauacaccuucucccccggaggucgaacgggcugugcuggacgacggcaucuaccgcauuaugcagagagggcugcucggacggagccagguuggcgugggggucuuccaagagaacguguuucauaccauguggcacguuacgcgcggagccgugcugauguaucagggcaagagacuugaaccuuccugggcgagcgucaaaaaggaucugaucucuuacgggggaggcuggcggcuccagggcuccuggaauaccggggaggagguccaggugauugcuguugaacccggcaagaacccuaagaauguccaaacagcccccggcaccuucaagacaccggagggggaagugggagccaucgcucuggacuuuaaaccuggcaccagcgggucucccauugugaacagagagggaaagaucgucggccucuacggcaauggggugguuacaacguccggaaccuaugugagcgccaucgcgcaggcuaaagccucccaggaaggcccucugcccgagauugaggaugaagucuuccgcaagcggaaccuuacaaucauggaccugcaccccgggucuggaaaaaccagacgcuaccugccugccauugugcgggaggcuaucaagagaaagcuccgcacccugauucuugccccgacacggguuguggcuagcgaaauggccgaggcgcugaaaggcaugcccaucagauaucaaacgaccgccgucaaguccgaacauacagggaaagagaucguggaucucaugugccacgcuaccuuuacaaugcgccugcugagcccuguucgggugcccaauuacaacaugauuaucauggacgaggcccauuucaccgauccuucuuccauugcugccagaggcuauaucagcacgcgggucggaaugggcgaagccgcugcgauuuuuaugacagccacacccccugggucuguggaggcuuucccgcagagcaaugccgugauccaggacgaggaacgcgauauccccgaaagauccuggaacucuggauacgaguggauuaccgacuuuccuggcaagacagucugguucguucccagcaucaaauccgggaaugauauugccaacugucuccggaagaauggaaagcgcgugauccagcuuucuagaaaaaccuucgacacagaguaucaaaagaccaaaaacaacgacugggauuacguggucacgacagacauuagcgaaaugggcgcuaauuuucgggccgauagagugaucgacccucgccggugccugaagcccguuauucugaaagaugggccggagagagugauccucgcgggcccuaugcccgucaccguggcuuccgccgcccagcgccggggaagaaucggccgcaaccacaauaaggaaggggaccaguacauuuauaugggacagccccugaacaaugaugaggaccaugcucacuggacagaggccaagaugcuucuggauaacaucaauaccccugaaggcauuauccccgcccuguucgagccugaacgggagaaaagcgccgcuauugacggggaauacagacugcgcggagaggccagaaagacguuuguugagcugaugcggcgcggcgaucucccgguguggcuuucuuauaaagucgcuuccgaaggguuccaauacagcgacagacgguggugcuuugauggcgagcgcaacaaucaggugcuggaagagaacauggacgucgaaaucuggaccaaggagggagagcgcaagaagcugcggcccagauggcucggcgcccgcacauauuccgacccucuggcccuucgggaguucaaagaguuugccgcggggagacgcucugugagcggagaucugauccucgaaauuggcaagcugccccagcaccugacccagcgggcccaaaaugcucucgacaaccuuguuaugcugcauaauuccgagcaagggggcagagcguaccggcacgcuauggaggaacugccugauacaaucgagacccucaugcugcuugcccugauugccgugcucacaggaggcgugacccuguucuuucugucugggcgcggacucggcaagacgagcaucgggcuucugugugucauggcuuccagcguucugcucuggauggcgucuguggaaccccauuggauugccgcuuccaucauccuggaguucuuucuuauggugcugcucauuccggaaccugacagacagcggacaccccaggauaaccaacuggccuaugucgugaucggacuccucuucaugauucuuaccguugccgcuaaugagaugggccugcuggagaccaccaaaaaggaccucgggaucggacacguggccgucgaaaaccaccaucacgcggccaugcuggauguggaccuucauccugcuagcgccuggacccuguacgcugucgccacaacgauuaucacccccaugaugcgccacacaauugagaacaccacagcgaauaucucucucaccgccaucgcuaaccaggccgcuauucugaugggccuggauaaaggcuggccuaucuccaagauggacauuggggugccccuccuugcccugggaugcuacagccagguuaauccgcugacgcucaccgcugccgugcugaugcuugucgcgcauuaugccaucauuggcccugggcugcaagcuaaagccacaagagaagcucagaagcggaccgccgccggaaucaugaagaaccccacaguggauggcaucguugcgauugaccucgaucccguggucuacgacgcuaaauuugagaagcagcuggggcagaucaugcugcucauucuuuguaccucucaaauccugcugaugcgcacgacaugggcccucugcgaaagcauuacccuggcuacaggaccucuuaccacccugugggagggcuccccgggcaaauucuggaauacaacgaucgccgugucuauggccaacaucuucagagggagcuaucucgcuggagccggccuggcguuuucccugaugaaaagccucgggggaggccggcgcgggaccggagcccagggcgagacacuuggcgaaaaauggaagagacggcugaaucagcuguccaagucugaguucaacaccuacaaaagaagcgggauuauggaaguggaccgcuccgaggcuaaggaaggacucaaacggggcgagacaaccaagcacgccguuucuagagggacggcuaaacugcgcugguuugucgagcggaaucuugugaagcccgaaggaaaggugaucgaucugggcugugggagaggaggcuggagcuauuacugcgccggccucaaaaaggucacagagguuaaaggguauaccaagggaggcccugggcacgaggagcccauuccuauggcgaccuacggauggaaccuggugaaacugcauuccggcaaggacguguucuuuauucccccugaaaaaugugauacacuccuuugcgacauuggggagucuagcccgaaucccaccaucgaggaaggacgcacacugcggguccugaagaugguggagccuuggcucagaggcaaccaguucuguauuaagauccugaaucccuacaugccuuccguuguggaaacgcuugagcaaaugcagcgcaaacacggcgggaugcugguccggaacccccucagcagaaauucuacccaugagauguauuggguguccugcggaacaggcaacaucguuagcgccgugaauaugaccucucgcaugcugcugaaccgguuuacaauggcucacagaaagccgaccuacgaacgcgaugucgaccucggggccggaacgagacacguggcuguggagccugaagucgccaaccuggauauuaucggccagcggauugagaauaucaaacaugaacacaaguccaccuggcauuaugacgaggauaaccccuacaaaacaugggcuuaucacgggagcuacgagguuaagcccucuggauccgccagcuccauggugaauggcguggucaaacuucugaccaaaccuugggacgugauucccaugguuacacagaucgcgaugaccgauacaaccccuuucggccaacagcgcguguuuaaggaaaaagucgacacgagaacaccgaaggccaaacgggggaccgcucagaucauggaggugaccgccagauggcucuggggauuccugagccggaacaagaagccccgcauuuguacaagagaagaguuuacgcggaaaguucgcucuaaugcugccaucggcgccguguucauugacgaaaaccaauggaauagcgcgaaggaggcugucgaggaugaaagauuuugggaccuugugcaucgggagcgcgaacugcacaaacaggggaagugcgcuaccugcguuuauaacaugaugggaaaaagagagaagaagcucggcgaguucgggaaagccaagggcucccgggcuaucugguacauguggcugggagcccgcuuccuggaguuugaggcucucggcuucaugaaugaagaucacugguuuucuagagagaacagccuguccgggguggaaggagagggccuucauaaacugggguacauucuccgggacaucucuaagaucccuggaggcaauauguaugccgaugacacagcggggugggauacccgcauuacagaggacgaucugcagaacgaagccaaaaucaccgacauuauggagcccgaacacgcccuucuggccaaggcuaucuucaaacucacauaccagaauaaggucgugagaguccaacggccugccaagaacggcaccgugauggauguuauuagccgcagagaccagcggggauccggccagguggggacguauggacugaauaccuuuacaaacauggaggcgcagcugaucagacaaauggaaucugagggcaucuucagccccuccgagcucgaaaccccgaaccuggccgagcgcguccuugauuggcuggggaaauacggaguggaacggcucaagagaauggcuauuagcggcgacgacugugugguuaaaccuaucgaugaccgcuuugccacagcucugaccgcccuuaaugauauggggaaggugcggaaagacauuccccagugggagccuucuaagggcuggaacgauuggcagcagguccccuucugcucccaucacuuucaccaacugaucaugaaggacggaagagaaauugugguuccuugucgcaaucaggaugagcucgugggccgggcuagagucagccagggggccggauggucucugcgcgagacggcgugccugggcaaauccuaugcccagauguggcaacucauguacuuccaucggagagaccugcgccuugcugccaacgccaucuguagcgcugugcccgucgauugggugccgacaucccggaccacauggucuauucacgcccaucaccaguggaugaccacggaagacaugcugagcguuuggaauagaguguggaucgaggaaaacccuuggauggaggauaagacccauaucuccaauugggaagacguccccuaucucgggaaacgggaggaccaguggugcggaagccugauuggccuuacagcgagagcuaccugggccacaaacauccaaguggccauuaaucagguucgccggcugaucgggaacgagaauuaccucgauuacaugaccucuaugaagagauuuaaaaacgaauccgaccccgagggcgcucugugguga

SEQ ID NO: 18480 - RNA, 9879 nt, Artificial Sequence
  derived and/or modified CDS sequence (opt5) from DENV-1__KF971869__SS-prME
agcgugaccaugcugcucaugcugaugcccacagcucuugcuuuccaccugacgaccagaggaggggagccucauaugaugguguccaagcaggaacggggaaaaucucuccuguuuaagaccagcgcuggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauccagcggguugaaacaugggcucugcgccaccccggcuucaccgugauugcccuuuuucuggcgcaugccaucgggacaucuauuacccagaagggaaucaucuucauucuccugaugcuugucaccccuagcauggcuaugagaugcgugggcaucgggucccgggauuuuguugagggacugagcggcgccacauggguggacgucgugcucgagcacgggucuugugugacgaccauggcuaaggauaaacccacacuggacauugaacugcucaagaccgaggucacaaacccugccguucugcgcaaacuuugcaucgaagcgaagauuuccaauaccacgacagauagcagauguccgacccaaggagaggccacccugguggaagaacaggacgcuaacuucgugugccggcgcacauuugucgauagaggcuggggcaauggguguggacucuucggcaaagggucucugaucacaugcgccaaguuuaagugcgugacaaaacuugagggaaagauuguucaguacgaaaaccugaaauauuccgugaucgucacggugcacaccggcgaccagcaucaaguugggaaugagagcacagaacacggaaccacagcuaccaucacgccccaggccccuaccacagagauucagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauccagacauccggaaccacaaccauuuuugcuggccaucucaaaugcagacugaagauggauaaacuuacgcugaaggggaugagcuaugugauguguacaggcucuuucaaacucgagaaggaagucgccgagacccagcacggaaccgugcugguucagaucaaguacgagggcacagacgcgccgugcaaaauuccuuucuccacccaagaugaaaagggggugacacagaacggacggcugaucacggcuaaucccaucgucaccgacaaagagaagccugugaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauucugggagauaccgccugggacuucggcucuaucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggcuggcauccucgcccaggggaaaaagaugauucggccgcaacccauggaguacaaauauucuuggaaaagcuggggaaaggccaagaucauuggcgcugacgugcagaauaccaccuuuaucaucgaugggccuaacacacccgaauguccugacgaucagagagcguggaauauuugggaggucgaggacuacggauucggcaucuuuaccacgaacauuuggcugaagcugcgcgauuccuauacacagguuugcgaccaccggcuuaugagcgccgcuaucaaagauucuaaggccgugcacgccgacaugggcuacuggauugaauccgagaaaaaugauaccuggaagcucgcuagagccagcuucaucgaagugaagacauguaucuggcccaaaucucauacccugugguccaacgggguccuggagagcgaaaugauuaucccgaagauuuauggaggcccuaucucucaacacaauuaccgccccggguacuucacacagaccgcgggaccuuggcaucucggcaaacuggagcuugacuuugaucugugcgaggggacgaccgugguuguggacgaacacugcggaaaccggggccccagccucagaacaaccacagucaccggcaagauuauccacgagugguguugccgguccuguacgcugccuccccugcgcuucagaggggaagacggaugcugguauggcauggagauccggccggugaaagagaaggaagagaaucuuguuaagagcauggugucugcuggguccggagaagucgauagcuuuucccucggccugcuguguauuucuaucaugauugaggaagugaugagaagccgcuggucccggaaaaugcucaugaucgggacacuggccguuuucuuucuucugauuaugggacagcucaccuggaacgaccugaucagacugugcauuauggugggcgccaaugcuucugaucgcaugggcauggggacaaccuaccuugcccugauggcgaccuucaagaugagaccuauguuugcugucggacuccuguuccggcgccucacaagcagagaggugcugcuucugacgaucggccucucccugguggccucugccgagcugcccaacagccuugaagaacugggggacggacucgcuaugggcaucaugauucugaaacuccugaccgauuuucaaucccaucagcuuugggccacacugcucagccugaccuucaucaagacaaccuuuucucugcacuaugcuuggaaaacgauggccaugguccuuuccauuguuagccuguucccccucugucugucuacaaccucccagaagaccacauggcucccugugcugcuugggagccugggaugcaagccgcugaccauguuucucaucgcggaaaauaaaauuuggggccggaagucuuggccccugaacgagggcaucauggccguggggaucgucuccauucuucugagcucccuccugaaaaacgacgugccucucgcuggaccccugaucgccggcgggaugcuuauugcuuguuacguuaucagcggaucuagcgccgaucugucccuggaaaaggccgcugaggugucuugggaggaagaggcggaacauagcggcgccucccacaauauucucgucgaggugcaggacgaugggacaaugaaaaucaaggacgaagaaagagaugacacgcugaccauccuucugaaagcuacacuccuggccguuucuggaguguucccucucagcauucccgccacccuguucgucugguauuuuuggcaaaagaagaaacagagauccggcgugcuuugggauacaccuucucccccggaggucgaacgggcugugcuggacgacggcaucuaccgcauuaugcagagagggcugcucggacggagccagguuggcgugggggucuuccaagagaacguguuucauaccauguggcacguuacgcgcggagccgugcugauguaucagggcaagagacuugaaccuuccugggcgagcgucaaaaaggaucugaucucuuacgggggaggcuggcggcuccagggcuccuggaauaccggggaggagguccaggugauugcuguugaacccggcaagaacccuaagaauguccaaacagcccccggcaccuucaagacaccggagggggaagugggagccaucgcucuggacuuuaaaccuggcaccagcgggucucccauugugaacagagagggaaagaucgucggccucuacggcaauggggugguuacaacguccggaaccuaugugagcgccaucgcgcaggcuaaagccucccaggaaggcccucugcccgagauugaggaugaagucuuccgcaagcggaaccuuacaaucauggaccugcaccccgggucuggaaaaaccagacgcuaccugccugccauugugcgggaggcuaucaagagaaagcuccgcacccugauucuugccccgacacggguuguggcuagcgaaauggccgaggcgcugaaaggcaugcccaucagauaucaaacgaccgccgucaaguccgaacauacagggaaagagaucguggaucucaugugccacgcuaccuuuacaaugcgccugcugagcccuguucgggugcccaauuacaacaugauuaucauggacgaggcccauuucaccgauccuucuuccauugcugccagaggcuauaucagcacgcgggucggaaugggcgaagccgcugcgauuuuuaugacagccacacccccugggucuguggaggcuuucccgcagagcaaugccgugauccaggacgaggaacgcgauauccccgaaagauccuggaacucuggauacgaguggauuaccgacuuuccuggcaagacagucugguucguucccagcaucaaauccgggaaugauauugccaacugucuccggaagaauggaaagcgcgugauccagcuuucuagaaaaaccuucgacacagaguaucaaaagaccaaaaacaacgacugggauuacguggucacgacagacauuagcgaaaugggcgcuaauuuucgggccgauagagugaucgacccucgccggugccugaagcccguuauucugaaagaugggccggagagagugauccucgcgggcccuaugcccgucaccguggcuuccgccgcccagcgccggggaagaaucggccgcaaccacaauaaggaaggggaccaguacauuuauaugggacagccccugaacaaugaugaggaccaugcucacuggacagaggccaagaugcuucuggauaacaucaauaccccugaaggcauuauccccgcccuguucgagccugaacgggagaaaagcgccgcuauugacggggaauacagacugcgcggagaggccagaaagacguuuguugagcugaugcggcgcggcgaucucccgguguggcuuucuuauaaagucgcuuccgaaggguuccaauacagcgacagacgguggugcuuugauggcgagcgcaacaaucaggugcuggaagagaacauggacgucgaaaucuggaccaaggagggagagcgcaagaagcugcggcccagauggcucgacgcccgcacauauuccgauccucuggcccuucgggaguucaaagaguuugccgcgggcagacgcucugugagcggggaccugauccucgaaauuggaaagcugccccagcaccugacccagcgggcccaaaaugcucucgauaaccuuguuaugcugcauaauuccgagcagggcgggagagccuaccggcacgcuauggaggaacugccugacacaaucgagacccucaugcugcuugcccugauugccgugcucacaggaggcgugacccuguucuuucugucuggccgcgggcucggaaagacgagcaucggccuucugugugucauggcuuccagcguucugcucuggauggcgucuguggaaccccauuggauugccgcuuccaucauccuggaguucuuucuuauggugcugcucauuccggaaccugauagacagcggacaccccaggacaaccaacuggccuaugucgugaucgggcuccucuucaugauucuuaccguugccgcuaaugagaugggacugcuggagaccaccaagaaggaucucggcaucgggcacguggccgucgaaaaccaccaucacgcggccaugcuggacguggaucuucauccugcuagcgccuggacccuguacgcugucgccacaacgauuaucacccccaugaugcgccacacaauugagaacaccacagcgaauaucucucucaccgccaucgcuaaccaggccgcuauucugaugggacuggacaaaggcuggccuaucuccaagauggauauuggcgugccccuccuugcccuggggugcuacagccagguuaauccgcugacgcucaccgcugccgugcugaugcuugucgcgcauuaugccaucauuggaccuggccugcaagcuaaagccacaagagaagcucagaagcggaccgccgccgggaucaugaagaaccccacaguggacggaaucguugcgauugaucucgaccccguggucuacgacgcuaaauuugagaagcagcugggccagaucaugcugcucauucuuuguaccucucaaauccugcugaugcgcacgacaugggcccucugcgaaagcauuacccuggcuacagggccucuuaccacccugugggagggauccccgggcaaauucuggaauacaacgaucgccgugucuauggccaacaucuucagaggcagcuaucucgcuggggccggacuggcguuuucccugaugaaaagccucggcgggggacggcgcggcaccggggcccagggagagacacuuggcgaaaaauggaagagacggcugaaucagcuguccaagucugaguucaacaccuacaaaagaagcggcauuauggaaguggaucgcuccgaggcuaaggaagggcucaaacggggagagacaaccaagcacgccguuucuagaggcacggcuaaacugcgcugguuugucgagcggaaucuugugaagcccgaagggaaggugaucgaccugggauguggcagagggggauggagcuauuacugcgccggccucaaaaaggucacagagguuaaaggcuauaccaaagggggaccuggccacgaggagcccauuccuauggcgaccuacggguggaaccuggugaaacugcauuccggaaaggauguguucuuuauucccccugaaaaaugugacacacuccuuugcgauauuggcgagucuagcccgaaucccaccaucgaggaagggcgcacacugcggguccugaagaugguggagccuuggcucagaggaaaccaguucuguauuaagauccugaaucccuacaugccuuccguuguggaaacgcuugagcaaaugcagcgcaaacacggcggcaugcugguccggaacccccucagcagaaauucuacccaugagauguauuggguguccugcgggacaggaaacaucguuagcgccgugaauaugaccucucgcaugcugcugaaccgguuuacaauggcucacagaaagccgaccuacgaacgcgacgucgaucucggcgccgggacgagacacguggcuguggagccugaagucgccaaccuggacauuaucggacagcggauugagaauaucaaacaugaacacaaguccaccuggcauuaugaugaggacaaccccuacaaaacaugggcuuaucacggcagcuacgagguuaagcccucuggguccgccagcuccauggugaauggaguggucaaacuucugaccaaaccuugggaugugauucccaugguuacacagaucgcgaugaccgacacaaccccuuucggccaacagcgcguguuuaaggaaaaagucgacacgagaacaccgaaggccaaacggggcaccgcucagaucauggaggugaccgccagauggcucuggggguuccugagccggaacaagaagccccgcauuuguacaagagaagaguuuacgcggaaaguucgcucuaaugcugccaucggagccguguucauugaugaaaaccaauggaauagcgcgaaggaggcugucgaggacgaaagauuuugggaucuugugcaucgggagcgcgaacugcacaaacagggcaagugcgcgaccugcguuuauaacaugauggggaaaagagagaagaagcucggagaguucggcaaagccaaggggucccgggcuaucugguacauguggcugggcgcccgcuuccuggaguuugaggcucucggauucaugaaugaagaccacugguuuucuagagagaacagccuguccggcguggaaggggagggacuucauaaacugggcuacauucuccgggauaucucuaagaucccugggggaaauauguaugccgacgauacagcgggcugggacacccgcauuacagaggaugaccugcagaacgaagccaaaaucaccgauauuauggagcccgaacacgcccuucuggccaaggcuaucuucaaacucacauaccagaauaaggucgugagaguccaacggccugccaagaacgggaccgugauggacguuauuagccgcagagaucagcggggcuccggacaggugggcacguaugggcugaauaccuuuacaaacauggaggcgcagcugaucagacaaauggaaucugagggaaucuucagccccuccgagcucgaaaccccgaaccuggccgagcgcguccuugacuggcugggcaaauacgggguggaacggcucaagagaauggcuauuagcggagacgauugugugguuaaaccuaucgacgaucgcuuugccacagcucugaccgcccuuaaugacaugggcaaggugcggaaagauauuccccagugggagccuucuaagggguggaacgacuggcagcagguccccuucugcucccaucacuuucaccaacugaucaugaaggauggcagagaaauugugguuccuugucgcaaucaggacgagcucgugggacgggcuagagucagccagggcgccggguggucucugcgcgagacggcgugccugggaaaauccuaugcccagauguggcaacucauguacuuccaucggagagaucugcgccuugcugccaacgccaucuguagcgcugugcccgucgacugggugccgacaucccggaccacauggucuauucacgcccaucaccaguggaugaccacggaagauaugcugagcguuuggaauagaguguggaucgaggaaaacccuuggauggaggacaagacccauaucuccaauugggaagacguccccuaucucggcaaacgggaggaucaguggugcgggagccugauuggacuuacagcgagagcuaccugggccacaaacauccaaguggccauuaaucagguucgccggcugaucggcaacgagaauuaccucgacuacaugaccucuaugaagagauuuaaaaacgaauccgaucccgagggggcucugugguga

SEQ ID NO: 18481 - RNA, 9879 nt, Artificial Sequence
  derived and/or modified CDS sequence (opt5) from DENV-1__JN903578__SS-prME
agcgugaccaugcugcucaugcugcuucccacagcccuggcuuuccaccucacgacccggggcggggagccucauaugaucgucuccaagcaagaacggggaaaaucucugcuuuuuaagacaagcguuggcgugaauaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagcggguggaaacaugggcccuucgccaccccggcuucaccgucaucgcucuguuucucgcccaugcgauugggacaucuaucacccagaagggaaucauuuucauccugcuuaugcuggugaccccuagcauggccaugagaugcguuggcauugggaaccgggauuuuguggagggacucuccggcgcuacaugggucgacguggugcuggagcacgggagcugugucacgaccauggccaagaauaaacccacacuggauaucgaacuccugaagaccgagguuacaaacccugcugugcuucgcaaacugugcauugaagccaagaucucuaauaccacgacagacuccagauguccgacccaaggagaggcgacccucguggaagaacaggaugccaacuucgucugccggcgcacauuuguggacagaggcuggggcaauggguguggacuguucggcaaagggagccuucugaccugcgcuaaguuuaagugcguuacaaaacucgagggaaaggugguccaguacgaaaaccugaaauauucugugauuguuacggugcacaccggcgaucagcaucaagucgggaaugagacaaccgaacacggaacaaucgccaccaucacgccccaggcuccuaccuccgagauucagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggccagcacaucccaagagaccuggaaucgccaggaucugcuggugacauucaaaaccgcucacgcgaagaagcaggaaguugugguccucggaucucaagagggcgccaugcacaccgcucugacaggggccacggaaauccagaccagcggaacaaccacaauuuuugccggccaucuuaaaugcagacugaagauggacaaacucacccugaaggggauguccuaugugauguguacgggcagcuucaaacuggagaaggaaguugcugagacacagcacggaaccgugcuuguccaggugaaguacgagggcaccgaugccccgugcaaaaucccuuuccucauucaagacgaaaagggggugacacagaacggacggcugaucaccgcgaaucccaucguuacagauaaagagaagccugucaacauugaaacggagccgcccuuuggcgagucuuauaucguggugggggcuggagaaaaagcccugaagcucuccagauucaagaaaggcagcucuauugggaagauguuugaggccaccgcucgcggcgcccggagaauggcuauccugggagacacagccugggauuucggcagcauugggggagucuuuaccuccgugggcaaacuuauccaucagguuuucgggacagcguacggagugcuguuuucuggcgucagcuggaccaugaagaucgggauuggcauccuccugacguggcugggacuuaauucccgcagcaccucucucuccaugacauguauuaccgugggcaugguuacacuguaccugggggugaugguccaggccgacagcggaugcgugaucaacuggaaaggccgggaacucaagugugggucuggaauuuucguuaccaacgaggugcacacauggaccgaacaauauaaguuucaggcugauuccccuaaaagacugagcgccgcuaucggcaaggccugggaggagggggucugcggcauucgcuccgcgacgcggcuugaaaauaucauguggaaacagaucucuaacgagcugaaucauauucuccuggaaaacgacaugaaguucacagugguggucggagacgccaauggcauccuggcucaggggaaaaagaugauuagaccgcaacccauggagcacaaauacagcuggaaguccuggggaaaggccaaaaucauuggcgcugauauccagaacaccaccuuuaucauugacgggccugauacacccgaauguccugacgaucagcgcgccuggaauaucugggagguugaggacuauggauucggcauuuuuaccacgaacaucuggcuuaagcuccgggauucuuacacacagaugugcgaccacagacugaugagcgccgcuauuaaagauuccaaggcggugcaugccgacaugggcuauuggaucgaaagcgagaaaaaugaaaccuggaagcuggcucgcgccucuuucaucgagauuaagacauguaucuggcccaaaucccacacccucuggagcaacggggugcuggaaucugagaugauuaucccgaagauuuacggaggcccuaucucccaacauaaucaccggcccggguauuucacacagaccgccggaccuuggcaccuuggcaaacuggagcucgauuuugacgucugcgaagggacgaccgugguuguggaugagcauugcggaaacagaggccccagccugcggacaaccacagucaccggcaagaucauucacgaaugguguugccgcucuuguacgcugccuccccuuagauucagaggggaagacggaugcugguacggcauggagaucagaccggugaaagaaaaggaggaaaaucucguucgcagcaugguguccgcugggagcggagaggucgacucuuuuucccugggccugcucugugugagcauuaugaucgaagagguuaugcgguccagauggucucgcaagaugcugaugacagggacccuugccguguucuuucugcucauuaugggacagcugacauggaacgaucugaucagacuuugcauuauggucggcgcgaaugugagcgaccggaugggcauggggaccaccuaccuggcucucauggccacauucaaaaugcgcccuauguuugccgugggacuccuguucagacggcugacgucccgcgagguccuucugcucaccaucggccugucucugguugcuagcgccgaacuucccaacucccuggaggaacucggggauggacuggcgaugggcaucaugaugcucaagcugcuuacagacuuucaaucucaucagcuguggaccacacuccugagccugaccuucauuaaaacgacacuuucccuggauuaugcuuggaagaccaucaccaugauucucagcaucgugucucuguuuccccucugucuguccacaaccagccagaaaacaacguggcuuccugugcugcuggggucuuucggaugcaagccgcucaccauguuucugauuacagagaacaagaucuggggcagaaaauccuggccccuuaaugaaggcaucauggccgucgggauugugagcauccugcucucuucccugcucaagaacgacguuccucuggccggaccccuuauugcuggcgggaugcugaucgccuguuacgugauuagcggauccagcgcugaucugucucucgagaaagccgcggaggucagcugggaagaggaagccgagcacuccggcaccucucauaauauccugguggaaguucaggacgaugggacaaugaagaucaaagacgaggagcgggaugacacccuuacgauucugcucaaggcuacccugcucgccgugagcggagucuauccuauguccauccccgcuacacuguucgugugguacuucuggcagaagaagaagcagcgcucuggcguccuuugggauaccccuagcccucccgaaguggagagagccguucuggacgacggcauuuaucggauccugcagcgcgggcuccugggaagaucccaggugggcgucgggguguuucaagauggaguuuuccacacaauguggcacgugacccggggcgccguccuuauguaccaggggaaaagacuggaacccucuugggcuagcgugaagaaagaccucauuuccuauggaggcggcuggcgcuuucaggggagcuggaacacaggagaggaggugcagguuaucgcggucgaacccggcaagaauccuaaaaacgugcaaacgacccccgggacauucaagaccccggagggagaagugggcgccauugcucuggauuuuaagccugggaccucuggaucccccaucgucaaucgggagggcaaaaucgugggccucuacgggaacggaguugugacaacgagcggcaccuacgucucugccauugcccaggcuaaggccucccaggaagggccucugcccgagaucgaggacgaaguguucaaaaagagaaaucuuacaauuauggaucugcaucccggaagcggcaaaacccgccgguaucugccugcgaucguuagagaggcuauuaagcgcaagcuccggacacugauccuugccccgaccagaguggucgccuccgaaauggcugaggcccugaaagggaugcccauccgcuaccaaacgacagcggugaagucugaacacaccggccgggagauuguugaccucaugugccaugcuaccuuuacaaugagacugcugagcccugugcggguccccaacuauaauaugaucauuauggaugaggcccacuucaccgacccugccuccaucgcugcccgcggauacauuagcacaagagugggcaugggggaagcugccgcgaucuuuaugaccgccacgcccccuggaucuguggaggcuuucccgcaguccaacgccgucauccaggaugaagagaaagacauucccgaacggagcuggaacucuggcuaugauuggaucacagacuuuccugggaagaccguuugguucgugcccagcauuaaauccggaaacgacaucgcuaauugucuccgcaagaacggcaagagagugauucagcuuucucggaaaacauucgauaccgaguaccaaaagacgaaaaacaaugacugggauuaugucgugaccacagacaucagcgagaugggggccaacuuuagagccgaucgcguuauugacccucggagaugccugaagcccgugauccugaaagauggcccggaacgcgucauccucgcuggaccuaugcccgugaccguugcguccgccgcucagcggagaggccgcauugggcggaaucagaacaaggagggagaccaguacguguacaugggccaaccccugaauaacgauggggaccaugcccacuggacagaagccaagaugcuucuggauaauaucaacaccccugagggaauuauccccgcucucuucgagccugaaagagagaaaucugccgcgauugacggcgaauaucgccugagaggggaggcucggaagacauuugucgaacugaugcgcagaggcgaucucccgguguggcuuagcuacaaagucgccuccgagggauuccaguauagcgaccggcgcuggugcuuugacggcgagagaaauaaccaggugcuggaagagaauauggauguugaaaucuggaccaaggagggggaacggaaaaagcugagaccccgcuggcucgacgcccggacguacucugauccucuggcucuuagagaguucaaagaguuugccgcgggacgccgguccgugagcggcgaccugauccucgaaauugggaagcugccccagcaccugacacucagagcccaaaacgcucuugauaaucuggugaugcugcauaacuccgagcagggaggcaaggccuaucggcacgcuauggaggaacucccugacaccaucgaaacccugaugcuucuggcccucauugcuguccugacaggcgggguuacccuguucuuucucucuggaaaaggccuugggaagacaagcaucggacugcugugugugauggccuccucugcgcuccuguggauggccagcguggagccccauuggauugcugccuccaucauccuugaguucuuucugaugguccuccugauuccggaaccugaucgccagagaacgccccaggacaaucaacuggcuuacgugguuaucggccuccuuuucaugauucugaccguggccgccaacgagauggggcugcucgaaacaaccaaaaaggaucugggaaucggccacgucgcugcggagaaccaccaucacgccacaaugcuugacguggaucugcggccugcuagcgccuggacccucuaugccgucgcuacgaccgugauuacacccaugaugcgccauaccaucgagaauacaaccgccaacauuucucugacggcgaucgccaaucaggcugccauccugaugggccucgacaaaggguggccuauuuccaagauggauaucggaguuccccuucuggcucugggcugcuacagccaggugaacccgcucacacugaccgccgcgguccuuaugcugguggcccacuacgcuauuaucgggccuggacuccaagccaaggcuacaagagaagcccagaaacggaccgcugccggcauuaugaagaaucccaccguugacgggaucguggcgaucgaccuggaucccgucguguaugacgccaaauuugagaagcagcugggacagauuaugcuccuuauccuguguacaucucaaauucugcucaugcgcacgaccugggcucugugcgaauccaucacacuugccaccggcccucugacaacccucugggagggcagcccggggaaauucuggaacacgacaauugcugugucuauggccaauaucuucagaggaagcuaccuggccggcgcggggcuggcuuuuucccucaugaagucucuuggaggcagccggcgcgggaccggagcccagggcgaaacccugggcgagaaguggaaaagacagcugaaccagcucuccaagagcgaguucaauacauauaaacgguccgggaucauggaaguugauagaucugaggcuaaggaaggacugaaacgcggcgagaccacaaagcaugccgucagccgggggacggccaaacuuagaugguuuguggaacgcaaccuggugaaacccgagggaaaggucauugaccucggcugugggcggggaggcugguccuacuauugcgcuggccugaaaaagguuaccgaggugaaaggguacacaaagggaggcccugggcacgaggagcccaucccuauggccaccuauggauggaaucuggugaaacuccacucuggcaaggaugucuucuuuauucccccugaaaagugugacacacuucugugcgauaucggggagagcuccccgaaccccaccauugaagagggaagaacgcugcgcgugcucaaaaugguugagccuuggcugcggggcaaucaauucuguaucaagauucuuaaccccuacaugccuucuguggucgaaacccuggagcagaugcagagaaaacauggcgggaugcucgugcgcaauccccugagccggaacuccacacacgaaauguacuggguuagcugcggaaccggcaauaucgugucugcggucaacaugacauccagaaugcugcucaaccgcuuuaccauggcccaucggaagccgacauaugagagagacguggaucugggggcuggaacccgccacguggccgucgagccugaaguugcuaaucuugacaucauuggccagagaaucgagaacauuaaaaaugaacacaagagcacguggcauuacgaugaggacaaccccuauaagacaugggccuaccacgggucuuaugaagugaaacccuccggaagcgcgucuuccauggugaauggcgucgugcggcugcucaccaagccuugggacguuauccccauggugacccaaauugccaugacagauacgaccccuuucggccagcagcgcgucuuuaaagagaagguggacacaagaaccccgcgggcuaaaagagggacagcccaaaucauggagguuaccgcuaaguggcuguggggauuccuuagccggaacaagaaaccccgcaucuguacaagagaagaguuuacccggaaggugcgcuccaaugccgcuauuggcgccgucuucguggaugaaaaccaguggaauagcgcgaaagaggccguugaagacgagagauuuugggaucuggugcaucgggagcgcgaacuccacaagcaggggaaaugcgcuacgugcgucuacaacaugaugggaaagagagagaagaaacugggcgaguucgggaaggccaaaggcucucgggcuaucugguauauguggcugggagcccgcuuccucgaguuugaagcccugggcuucaugaaugaggaccauugguuuagcagagagaacucccuuucugggguggaaggagagggccugcacaagcucggguacauucugcgggauaucagcaaaauuccuggaggcaauauguacgcggacgauaccgcugggugggacacacgcaucaccgaagaugaccuucagaacgaggccaagaucacagauauuauggagcccgaacacgcccugcucgcuaccuccaucuucaaacugacguaucaaaauaaggucgugagaguucagcggccugccaagucuggcacagugauggacgucauuagccgcagagaccagcggggauccggccagguggggaccuacggacugaacacauuuaccaacauggaggugcaacucaucagacagauggaaucugagggcauuuuccugcccagcgaacuugagacgccgaaucuggcuaaacgcguucucgauuggcuggagaagcauggggccgaacggcuuaaaagaauggcgaucuccggagacgauuguguggucaagccuaucgacgaucgcuuugccaccgcucugacagcccucaacgacaugggcaaagugcggaaggauauuccccagugggagccuagcaagggguggaaugacuggcagcaaguucccuucugcucucaccauuuucaccagcugaucaugaaagauggcagagaaauuguggucccuugucgcaaccaggacgagcuggugggacgggcuagagucucccagggcgccggguggagccuccgcgaaaccgcgugccugggaaagucuuaugcccaaauguggcagcuuauguacuuccaccggagagaucugcgccucgcugccaaugcuaucuguuccgccgugcccguugacugggugccgacaagccggaccacaugguccauucaugcucaccaucaguggaugaccacggaggacaugcugucugucuggaacagaguguggaucgaggaaaauccuuggauggaggauaaaacacacguuagcuccugggaagaggugcccuaucuuggcaagcgggaagaccaauggugcgggagccugauuggacucaccgccagagcgaccugggccacaaacauccaggucgcuaucaaucaggugcgccggcugauuggcaacgagaauuaccuggauuauaugaccacaaugaaaagauuuaagaacgagucugaccccgaaggggcccucugguga

SEQ ID NO: 18482 - RNA, 9879 nt, Artificial Sequence
  derived and/or modified CDS sequence (opt5) from DENV-1__JN903579__SS-prME
agcgugaccaugcugcugaugcugcuucccaccgcucuggcuuuccaccucacgacccggggaggggaaccucauaugauugucggaaagcaggaacggggcaaaucccugcuuuuuaagacaucugcugggguuaacaugugcacccugauugcgauggaccucggagagcugugugaagauacaaugaccuacaaaugcccccgcaucacagaggcugaacccgacgauguggacuguuggugcaaugccaccgauacgugggugaccuauggcacauguagccaaaccggggagcacagacgggacaagcgcuccgucgcccuggcuccucaugugggacucggccuggagacaagaaccgaaacguggaugucuagcgagggcgccuggcggcagauucagaaaguugaaacaugggcccuucgccaccccggguucaccgugaucgcccuguuucucgcgcaugccauuggaacauccaucacccagaagggcaucauuuucauccugcuuaugcuggucaccccuucuauggcuaugagaugcguggggauuggaaaccgggauuuuguugagggccucagcggggccacauggguggacgucgugcuggagcacggauccugugugacgaccauggcuaagaauaaacccacacuggauaucgaacuccugaagaccgaggucacaaacccugccguucuucgcaaacugugcauugaagcgaagaucagcaauaccacgacagacucuagauguccgacccaaggcgaggccacccucguggaagaacaggaugcuaacuucgugugccggcgcacauuugucgacagaggcugggggaauggauguggccuguucgggaaaggaucccuucugaccugcgccaaguuuaagugcgugacaaaacucgagggcaagauuguucaguacgaaaaccugaaauauagcgugaucgucacggugcacaccggggaucagcaucaaguuggaaaugagacaaccgaacacggcacaaucgcuaccauuacgccccaggccccuaccucugagauccagcugacagacuacggcgcccucacccuggacuguagcccccggacagggcuugauuucaacgaaauggugcugcucaccaugaaggagaaaagcuggcugguccauaagcagugguuucuugaccugccucuccccuggacgucuggagcuuccacaagccaagagaccuggaaucgccaggaucugcuggugacauucaaaaccgcgcacgccaagaagcaggaagucgugguucucggcucccaagagggggcuaugcacaccgcccugacaggagccacggaaauucagaccucuggcacaaccacaaucuuugcugggcaucuuaaaugcagacugaagauggacaaacucacccugaagggcgugagcuaugucauguguacgggauccuucaaacuggagaaggaaguggccgagacacagcacggcaccguucuugugcaggucaaguacgaggggaccgaugcgccgugcaaaauuccuuucagcacacaagacgaaaagggagugacccagaacggccggcucaucacagcuaaucccaucgugacggauaaagagaagccuguuaacauugaaaccgagccgcccuuuggggagucuuauaucgucauuggagccggcgaaaaagcccugaagcuguccugguucaagaaagggagcucuaucggcaagauguuugaggcuacagccagaggagcucgccggauggccauucucggcgacaccgcgugggauuucgggagcaucggaggcguguuuacauccguggggaaacugguccaucagguguucggaaccgccuacggcguucucuuuucuggggugagcuggacgaugaagaucggcauuggaauccugcucaccuggcugggccucaauuccagaagcacaucucuuuccaugaccuguauugcugucgggauggugacacucuaccugggaguuauggugcaggccgacaccggcugcgucaucaacuggaaagggcgcgaacugaaguguggaagcggcauuuucgugacaaacgagguucacaccuggacggaacaauauaaguuucaggcugauucuccuaaacggcucuccgccgcgaucgggaaggccugggaggagggcgugugcggaauuagaagcgcuacacgccuggaaaauaucauguggaaacagaucuccaacgagcuuaaucauauucugcucgaaaacgacaugaaguucaccgucguggugggcgacgccaaugggauccugacccagggcaagaagaugauucggccgcaacccauggagcacaaauacucuuggaaaagcuggggcaaggcuaagaucauuggggccgauacacagaacaccacguuuaucaucgacggaccugauacacccgaauguccugacgaucagagagccuggaauauuugggaggucgaggacuauggcuucggcaucuuuaccacaaacauuuggcugaaacuucgcgauuccuacacccagaugugcgaccaccggcucaugucugcugcgaucaaagauagcaaggccguucaugcugacaugggguauuggauugaauccgagaaaaaugaaacauggaagcuggccagagccagcuucaucgaggugaagaccuguaucuggccccgcucucacacgcugugguccaacggagugcucgaaagcgagaugauuaucccgaaaauuuacggcgggccuaucucucaacauaauuaucggcccggauacuucacccagacagcuggcccuuggcaccuggggaaacuugagcuggauuuuaaccucugcgaaggaaccacagucgugguugacgagcacugcggcaauagaggccccucccugcggaccacgacagugaccgggaaaauuauccaugaaugguguugccgcagcuguacacugccuccccuuagauuccggggagaggauggcugcugguacgggauggagaucagaccggucaaggaaaaagaggaaaaccucgugcgcucuaugguuagcgccggauccggcgagguggacagcuuuucucuggggcugcucugugucuccauuaugaucgaagaggugaugcggagcagauggucccgcaagaugcugaugaccggaacccuugcgguuuucuuucugcucauuaugggccagcugacauggaaugaccugaucagacuuugcauuauggugggcgcuaacgucucugaucggauggggaugggaacgaccuaucuggcccucauggccacauucaagaugcgcccuauguuugcugugggccugcuuuucagacggcugaccagccgcgaggugcuucugcucacaaucgggcugucccuggucgccucugcggaacuucccaacagccuggaggaacucggagacggccuggcuauggggauuaugaugcucaaacugcuuaccgauuuucaaucccaccagcuguggacgacacuccugucucugaccuucaucaagaccacacuuagccuggacuacgccuggaaaaccaucgccaugauucucuccaucguuagccuguuuccccucugucugucuacaacgucccagaagaccacauggcuuccugugcugcugggguccuucggcugcaaaccgcucaccauguuucugauuacagagaauaagaucuggggcagaaagucuuggccccuuaacgaagggauuauggcugugggaaucgucuccauccugcucagcucucugcucaaaaaugaugugccucuggccggcccccuuauugcugggggaaugcugaucgccuguuauguuauuuccggcagcuccgcggaccugagccucgagcgggccgcugaggugucuugggaagaggaagccgagcauagcggggcuucccacaacauccuggucgaagugcaggaugacggaaccaugaagauuaaagaugaggagcgcgacgauacgcuuaccauccugcucaaggccacacugcucgccguuucuggcguguacccuaugagcauccccgcuacccuguucgucugguauuucuggcagaagaagaaacagagauccggcgugcuuugggacacaccuucucccccggaagucgagcgggcggugcuggaugacgggauuuaccgcauccugcagagaggacuccugggccggagccagguuggggugggagucuuucaagacggcguguuccauaccauguggcacguuacaagaggggccgugcuuauguaucagggaaagcgccuggaaccuuccugggcuucugucaagaaagaucucauuagcuacggcggcggguggcgguuucagggauccuggaauacgggcgaggaggugcaagugaucgccguugaacccgggaagaacccuaaaaauguccaaaccacacccggaaccuucaagaccccggagggcgaagugggggccauugcucuggacuuuaaaccuggaacaagcggcucucccaucgugaacagagagggcaagauugucgggcucuacggaaauggcgugguuacgaccuccgggacauaugugagcgccaucgcgcaggcuaaggccucucaggaaggaccucugcccgagaucgaggaugaagucuucaaaaagcgcaaccuuaccauuauggaccugcaccccggcuccgggaaaacacggagauaccugccugccaucgugcgcgaggcuauuaagcggaaacucagaacccugauccuugccccgacgcgcguuguggcgagcgaaauggcugaggcccugaagggcaugcccauucgguaucaaacaaccgccgucaaguccgaacauaccggaagagagaucguggaucucaugugccacgcuacauuuaccaugcggcugcugucuccuguucgcgugcccaauuacaacaugaucauuauggacgaggcccauuucacagauccugcuagcaucgccgcgagaggcuauauuuccacccgggucgggaugggagaagccgcugccaucuuuaugacggcuacacccccuggcagcguggaggccuucccgcagucuaaugccgugauucaggacgaagaacgcgauauccccgaaagauccuggaacagcggguacgacuggaucaccgauuuuccuggaaaaacagucugguucguucccucuauuaagagcggcaaugacaucgcuaacugucuccggaaaaacgggaagagagugauucagcuuucccgcaaaaccaucgacacggaguaucaaaagaccaagaauaacgauugggacuacguggucacaaccgauauuucugagaugggcgcgaauuuccgggccgacagagugaucgauccucgccggugccugaaacccguuauucugaaggacggaccggaaagagugauccucgcuggcccuaugcccgucacagccgccagcgcugcccagcgccgggggagaaucggacgcaaccagaauaaagagggcgaucaguacauuuauauggggcaaccccugaacaaugacgaagaucacgcgcauuggaccgaggcuaagaugcuucuggacaacaucaauacaccugagggaauuauccccgcccucuuugaaccugagagagaaaaauccgccgcuauugauggcgaguaccggcugcgcggggaagccagaaagaccuucguggagcugaugcggcgcggcgaccucccgguuuggcuuucuuauaagguggcgagcgagggauuucaguacuccgauagacgguggugcuucgacggcgaaagaaacaaucagguccuggaggaaaacauggacguggagaucuggacgaaagaaggggagcgcaagaaacugcggcccagauggcucgaugcccgcacauauagcgacccucuggcccuucgggaguuuaaggaguucgccgcuggaagacggucugucuccggcgaucugauccucgagauugggaaacugccccagcaccugacccuccgcgcccaaaaugcucuugacaaccuggugaugcugcacaauagcgaacagggaggcaaggccuacagacaugcgauggaggaacucccugauaccaucgagacacugaugcuucuggcccucauugcuguucugaccggcggggugacacuguuuuuccucuccggaaaaggccuugggaagacgucuaucggacugcugugugugauggccagcuccguccuccuguggauggcuucuguugagccccacuggauugccgccagcaucauccuugaauuuuuccugauggugcuccugauuccggagccugaccggcagcgcacaccccaggauaaccaacuggcuuauguggucaucggcucccucuuuaugauucuuacaguggcggccaacgaaauggggcugcuggagaccacaaagaaagaccucggaaucggccauguuguggcugagaaucaccaccaugccaccacgcuggauauugaccuucacccugccagcgcuuggacccuguacgccgucgcgacaaccaucauuacacccaugaugagacauaccaucgaaaacacgacagccaauaucucucucaccgcuauugccaaccaggcugccauccugaugggccuggauaagggguggccuauuuccaaaauggacaucggagugccccuccuugcgcugggcugcuacagccaggucaauccgcugacacucaccgccgcugugcugaugcuuguugcccacuaugcuauuaucgggccuggacugcaagccaaggcuacccgggaggcccagaaacgcacagcggccggcaucaugaagaaccccacgguggaugggauugucgcuaucgaccucgaccccgugguuuacgaugccaaguucgaaaaacagcugggacagauuaugcugcucauccuuuguaccucucaaauucugcugaugagaacaaccugggcucucugcgaguccaucacacuggccaccggcccucuuacgacacugugggaaggcagcccggggaaguuuuggaauaccaccaucgccgugucuauggcgaacauuuuccggggaagcuaucucgcuggcgccgggcuggcuuucucccugaugaaaucucucggaggcgggcgcagaggaacaggcgcccagggcgagacccuuggggagaaguggaaacggcagcugaaucagcugagcaaguccgaauuuaacacauacaagagaagcggaaucauggaggucgaccgcuccgaagccaaagagggccucaagagaggggaaacgaccaaacaugcugugucuagaggaacagccaagcugcgcugguucguggagcggaaucuuguuaaacccgagggcaaggucauugaucugggguguggaagaggcggcuggagcuauuacugcgcggggcucaagaaagugaccgaagugaagggauauacaaaaggcgggccuggacacgaggaacccaucccuauggccaccuacggcuggaacauugucaagcugcacuccgggaaagacguguuuuucacgcccccugagaagugugauacccugcucugcgacaucggagaaucuagcccgaaucccacaauugaggagggccgcacccuucggguucugaaaaugguggaaccuuggcugagaggcaaccaauuuuguaucaagauccucaaucccuacaugccuuccgucguggagacacuggaacagaugcagcgcaagcaugggggaaugcuuguucggaacccccugucuagaaauagcacccacgagauguauuggguguccugcggcacagggaacauugucagcgcugugaacaugaccucucgcaugcuccugaaucgguucacgauggcccauagaaaaccgacauacgagcgcgauguugaccugggagcuggcaccagacacguggccgucgaaccugagaucgcgaaccucgauauuaucgggcagcggauugaaaauaucaagaacgagcacaaauccaccuggcauuaugacgaagauaaucccuacaagacaugggccuaucacggaagcuacgaggugaaacccucuggcuccgcuagcucuauggugaacggcgucguucgccugcuuacgaagccuugggacgugauccccauggugacccaaauugccaugacagacaccacaccuuuugggcagcagagagucuucaaggagaaaguggauacccggacaccgagacccaagcggggaaccgcucaaaucauggaaguuacggccaaauggcuguggggcuuucucucccgcaauaagaaaccuagaauuuguacccgggaggaguucacacgcaaggugagaagcaacgcugccaucggggcggucuuuguggacgagaaucaguggaacuccgccaaggaagcuguugaggaugagcgguucugggaccuggugcaucgcgaaagagagcuucacaaacagggaaagugcgcuaccugcgucuauaauaugaugggcaaacgggaaaagaaacugggggaguuuggcaaggccaagggaagccgcgccauuugguacauguggcucggcgccagauuccuggaguucgaggcgcugggguuuaugaacgaggaucauugguucucucgggaaaauagccucuccggaguggagggcgaagggcuguacaaacuuggauauauccugcgcgacaucucuaagauucccggcgggaacauguacgcugaugacacagccggcugggauaccagaaucacggaggacgaucuccagaaugaggccaaaauuacagacaucauggaaccugagcacgcucugcuugccaccagcauuuuuaagcugacauaucaaaacaaaguugugcggguccagcgccccgcuaaguccggaaccgugauggaugucaucucuagacgggaccagagaggcagcggacaggugggaacguacggccucaacaccuucacaaauauggaaguucaacugauccgccagauggaguccgaagggaucuuuucuccgagcgagcuggagaacuccaaucucgccgaacgggugcuggacuggcuugagaaacacggagucgaaagacugaagcgcauggcgaucagcggcgaugacuguguggugaagccuaccgaugaccgguucgccacagcucucaccgcccugaacgauauggggaaaguuagaaaggacauuccccagugggagccuucuaaaggcuggaaugauuggcagcaagugcccuuuugcucccaucacuuccaucagcuuaucaugaaggacggacgcgaaauugucgugccuugucggaaccaggaugagcugguuggcagagcucgcgugagccagggggccggauggucucuccgggagacagcgugccugggcaaauccuaugcccaaauguggcagcugauguacuuucacagacgcgaccuccggcuggcugccaaugcuaucuguagcgccguccccgugaacugggucccgaccuccagaacgacauggucuauucacgcucaucaccaguggaugaccaccgaagauaugcuuagcguguggaaucggguuuggaucgaggaaaacccuuggauggaggacaagacacauguguccagcugggaagacguccccuaucuggggaagagagaggaucaauggugcggaucucucaucggccugaccgcccgcgcgacaugggccacgaauauucagguggcuaucaaccagguucggagacuuauugggaaugagaacuacuccgacuacaccacaagcaugaaacgcuucaagaaugaaucugaucccgagggcgcccugugguga

SEQ ID NO: 18483 - RNA, 9879 nt, Artificial Sequence
  derived and/or modified CDS sequence (opt5) from DENV-1__JN903580__SS-prME
agcgugaccaugcugcucaugcugcuucccacagcucuggcuuuccaccucacgaccagaggcggggagccucauaugaucgucuccaagcaggaacggggaaagucucugcuuuuuaagacaagcgcuggcguuaauaugugcacccugauugcgauggaccucggggagcugugugaagauacaaugaccuacaagugcccccgcaucacagaggcugaacccgacgauguggacuguuggugcaaugcuaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaggaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuuucucuacacaagacgaaaagggggugacccagaacggacggcucaucacagcuaaucccaucgugacggauaaagagaagccuguuaacauugaaaccgagccgcccuuuggcgaguccuauaucgucauuggggccggagaaaaagcccugaagcugagcugguucaagaaaggcucuagcaucgggaagauguuugaggcuacagccagaggcgcucgccggauggccauucucggagacaccgcgugggauuucggcuccaucgggggaguguuuacaucugugggcaaacugguccaucagguguucgggaccgccuacggaguucuuuuuagcggcguguccuggacgaugaagaucgggauuggcauccugcucaccuggcugggacugaauagcagaaacacaucucuuuccaugaccuguauugcugucggcauggugacacucuaccuggggguuauggugcaggccgacaccggaugcgucaucaacuggaaaggccgcgaacugaagugugggagcggaauuuucgugacaaaugagguucacaccuggacggaacaauauaaguuucaggcugauucuccuaaacggcucuccgccgcgaucggcaaggccugggaggagggggugugcggcauuagaagcgcuacacgccuggaaaacaucauguggaaacagaucuccaaugagcuuaaccauauucugcucgaaaaugacaugaaguucaccgucguggugggagacgccaacggcauccugacccaggggaaaaagaugauucggccgcaacccauggagcacaaauacucuuggaaaagcuggggaaaggcuaagaucauuggcgccgauacacagaauaccacguuuaucaucgacgggccugauacacccgaauguccugacgaucagagagccuggaacauuugggaggucgaggacuauggauucggcaucuuuaccacaaauauuuggcugaaacuucgcgauuccuacacccagaugugcgaccaccggcucaugucugcugcgaucaaagauagcaaggccguucaugcugacaugggcuauuggauugaauccgagaaaaacgaaacauggaagcuggccagagccagcuucaucgaggugaagaccuguaucuggccccgcucucacacgcugugguccaauggggugcucgaaagcgagaugauuaucccgaaaauuuacggaggcccuaucucucaacauaacuaucggcccggguacuucacccagacagcuggaccuuggcaccugggcaaacuugagcuggauuuuaaucucugcgaagggaccacagucgugguugacgagcacugcggaaacagaggccccucccugcggaccacgacagugaccggcaaaauuauccaugaaugguguugccgcagcuguacacugccuccccuuagauucagaggggaagauggaugcugguacggcauggagauccggccggucaaggaaaaagaggaaaaucucgugcgcucuaugguuagcgccggguccggagagguggacagcuuuucucugggccugcucugugucuccauuaugaucgaagaggugaugaaaagccggugguccagaaagaugcugaugaccgggacccuugcgguuuucuuucugcucauuaugggacagcugacauggaacgaccugauccgccuuugcauuauggugggcgcuaacgucucugauagaaugggcauggggacgaccuaucuggcccucauggccacauucaaaaugcggccuauguuugcugugggacuccuguuccgcagacugaccagccgggaggugcuucugcucacaaucggccugucccuggucgccucugcggaacuucccaauagccuggaggaacucggggacggacuggcuaugggcauuaugaugcucaagcugcuuaccgauuuucaaucccaccagcuguggacgacacuccugucucugaccuucaucaaaaccacacuuagccuggacuacgccuggaagaccaucgccaugauucucuccaucguuagccuguuuccccucugucugucuacaacgucccagaaaaccacauggcuuccugugcugcuggggagcuucggaugcaagccgcucaccauguuucugauuacagagaacaagaucuggggccgcaaaucuuggccccuuaaugaaggcauuauggcuguggggaucgucuccauccugcucagcucucugcucaagaacgaugugccucuggccggaccccuuauugcuggcgggaugcugaucgccuguuauguuauuuccggaagcuccgcggaccugagccucgagagagccgcugaggugucuugggaagaggaagccgagcauagcggcgcuucccacaauauccuggucgaagugcaggaugacgggaccaugaaaauuaaggaugaggagcgggacgauacgcuuaccauccugcucaaagccacacugcucgccaucucuggaguuuacccuaugagcauucccgcuacccuguucgugugguauuucuggcaaaagaaaaagcagcgcuccggcguccuuugggacacaccuucucccccggaaguggagagagcgguccuggaugacggcaucuaccggauucugcagcgcgggcuccugggaagaagccaggugggcguugggguguuucaagacggagucuuccggaccauguggcaugugacaagaggcgccguucuuauguaucaggggaagcgccuggaaccuuccugggcuucugugaaaaaggaucucaucagcuacggaggcggcuggcgguuucagggguccuggaacacgggagaggagguccaggugauugccguggaacccggcaaaaauccuaagaacguucaaaccacacccgggaccuucaaaaccccggagggagaagucggcgccaucgcucuggacuuuaagccugggacaagcggaucucccauugugaauagagagggcaagaucgugggccucuacgggaacggagucgugacgaccuccggcacauauguuagcgccaucgcgcaggcuaaagccucucaggaagggccucugcccgagauugaggaugaaguguucaagaaacgcaaucuuaccaucauggaccugcaccccggauccggcaagacacggagauaccugccugccauuguccgcgaggcuaucaaacggaagcucagaacccugauucuugccccgacgcgcgugguugcgagcgaaauggcugaggcccugaaggggaugcccauccgguaucaaacaaccgccgugaaauccgaacacaccggcagagagaucgucgaucucaugugccaugcuacauuuaccaugcggcugcugucuccugugcgcguucccaacuacaauaugauuaucauggacgaggcccacuucacagauccugcuagcauugccgcgagaggauauaucuccacccgggugggcaugggggaagccgcugccauuuuuaugacggcuacacccccuggaagcgucgaggccuucccgcagucuaacgccgugauccaggacgaagaacgcgauauccccgaaagauccuggaauagcggcuacgacuggauuaccgauuuuccugggaagacagugugguucguccccucuaucaaaagcggaaacgacauugcuaacugucuccggaagaauggcaaaagaguuauccagcuuucccgcaagaccuucgacacggaguaucaaaagaccaaaaacaaugauugggacuacguggugacaaccgauauuucugagaugggggcgaacuuucgggccgacagagucaucgauccucgccggugccugaagcccgugauucugaaagacggcccggaaagaguuauccucgcuggaccuaugcccgugacagccgccagcgcugcccagcgccggggcagaaucgggcgcaaucagaacaaggagggagaucaguacauuuauaugggccaaccccugaauaacgacgaagaucaugcgcacuggaccgaggcuaaaaugcuucuggacaauaucaacacaccugaggggauuauccccgcccucuucgaaccugagagagaaaaguccgccgcuauugauggagaguaccggcugcgcggcgaagccagaaagaccuuugucgagcugaugcggcgcggggaccucccgguguggcuuucuuauaaaguugcgagcgagggcuuccaguacuccgauagacgguggugcuuugacggagaaagaaauaaccaggugcuggaggaaaauauggacgucgagaucuggacgaaggaaggcgagcgcaaaaagcugcggcccagauggcucgaugcccgcacauauagcgacccucuggcccuucgggaguucaaagaauuugccgcugggagacggucuguguccggagaucugauccucgagauuggcaagcugccccagcaucugacccuccgcgcccaaaacgcucuugacaaucuggucaugcugcacaacagcgaacaagggggaaaagccuacagacacgcgauggaggaacucccugauaccaucgagacacugaugcuucuggcccucauugcugugcugaccggcggcguuacacuguucuuucucuccgggaagggacuuggcaagacgucuaucgggcugcugugugugauggccagcuccgugcuccuguggauggcuucugucgagccccauuggauugccgccagcaucauccuugaguucuuucugaugguucuccugauuccggagccugaccggcagcgcacaccccaggauaaccaacuggcuuauguggugaucggacuccuuuucaugauucugacagucgcggccaaugaaaugggccugcucgagaccaccaagaaggaccuggggaucggacacgugguugcugagaaccaucaccacgccaccaugcuugauauugaccugcauccugccuccgcuuggacgcucuacgccguggcgaccacaaucauuacccccaugaugagacacacaaucgaaaauaccacggccaacaucagccugacagcuauugccaaucaggcugccauccugaugggccucgauaaaggcuggccuauuucuaagauggacaucggggucccccuucuggcgcugggaugcuacucccaggugaacccgcucacccugacagccgcuguccuuaugcugguggcccauuaugcuauuaucggcccugggcuccaagccaaagcuacccgggaggcccagaagcgcaccgcggccggaaucaugaagaaucccacaguugauggcauuguggcuaucgaccuggaccccgucguguacgaugccaaauuugaaaagcagcuggggcagauuaugcuccuuauccuguguacgagccaaauucugcucaugagaaccacaugggcucugugcgagucuaucacccuugccacaggaccucugaccacgcucugggaaggcuccccgggcaaauucuggaacacaaccaucgccguuagcauggcgaauauuuuccgggggucuuaucuggcuggagccggccuggcuuuuagccucaugaagucccuugggggaggccgcagagacaccggggcccagggagagacacugggcgagaaauggaagcggcagcugaaccagcucucuaagcccgaguucaauaccuacaaaagaagcggcaucauggagguggaucgcuccgaagccaaggaggggcugaaacggggagaaacaacgaagcacgcugucagcagaggcaccgccaaacuucgcugguuuguggagcggaaccuggugaagccugaggggaagguuauugaccucggauguggcagagggggaugguccuauuacugcgcgggccugaaaaaggucacagaagugaaaggcuauaccaaagggggacccggccaugaggaaccuauccccauggccacauacggguggaauauugugaaacugcacucuggaaaggaugucuucuuuaccccuccggagaaaugugacacgcuccuuugcgauaucggcgaaagcucccccaacccuaccauugaggaggggcgcacacugcggguucugaagaugguggaacccuggcucagaggaaaucaauucuguaucaagauccugaacccuuacaugcccucuguggucgagacccuugaacagaugcagcgcaaacacggcggcaugcuggugcggaauccgcucagcagaaacuccacacaugagauguauuggguuucuugcgggaccggaaacauugugagcgcugucaauaugacaucccgcaugcugcugaaccgguuuaccauggcccacagaaagccuacguacgagcgcgacguggaucucggcgcugggacaagacauguugccguggaacccgagaucgcgaaucuggacauuaucggacagcggauggaaaacauuaaaaaugagcacaagagcaccuggcacuaugaugaagacaaccccuacaaaaccugggccuaucauggcucuuacgaggucaagccuuccgggagcgcuucuuccauggugaauggagugguccgccuucugacaaagcccugggacguuaucccuauggugacgcaaaucgccaugaccgauacaaccccguucggccagcagagaguguuuaaagagaaggucgacacacggacccccagaccuaaacggggcacagcucaaauuauggaagugaccgccaaguggcucuggggguuccugagccgcaacaaaaagcccagaaucuguacgcgggaggaauuuacccgcaagguuagaucuaaugcugccauuggagcgguguucgucgaugagaaccaguggaacuccgccaaagaagcuguggaggacgagcgguuuugggaucuuguucaccgcgaaagagagcugcauaagcagggcaaaugcgccacaugcguguauaacaugauggggaagcgggagaagaagcucggagaguucggcaaggcuaaagggagccgcgccaucugguacauguggcugggcgccagauuccuggaauuugaggcgcucggauucaugaaugaggaccacugguuuucccgggaaaacagccugucuggcgucgagggggaaggacuuuacaagcugggcuauauucuccgcgauaucagcaaaaucccugggggaaauauguacgcugacgauaccgccggcugggacacaagaauuaccgaggaugaccugcagaacgaggccaagaucacggauauuauggaacccgagcaugcccuucuggccacauccaucuucaaacucaccuaucaaaacaaggugguucgggugcagcgcccggcuaaaucugggacagucauggacgugauuagcagacgggaccagagaggcuccggacaggucggcaccuacgggcugaauacguuuaccaacauggaagugcaacugauccgccagauggagucugaaggaaucuucagcccuuccgagcucgaaaauucuaaccuggccgaacggguucuugauuggcuggagaagcacggcguggaaagacucaagcgcauggcgauuagcggggacgauugugucgugaaacccacagacgaucgguuugccaccgcucugacagcccuuaaugacaugggaaaggugagaaaagauaucccucagugggagcccuccaagggcuggaacgacuggcagcaaguuccuuucugcagccaccauuuucaccagcugauuaugaaagaugggcgcgaaaucgugguccccugucggaaucaggacgagcucgugggcagagcucgcguuucucagggagccggcuggucccugcgggagaccgcgugccugggaaagagcuaugcccaaauguggcagcucauguacuuccauagacgcgaucugcggcuugcugccaacgcuauuuguucugccgugccggucaauugggugccuacauccagaaccacguggagcauccacgcucaccaucaguggaugacaaccgaagacaugcuguccgucuggaaccggguguggauugaggaaaaucccuggauggaggacaagacccacguuucuagcugggaagaugugcccuaucucgggaaaagagaggaccaauggugcggcucccugaucgggcuuacagcccgcgcgaccugggccacaaacauccaggucgcuauuaaucaggugcggagacugaucggaaacgagaauuacagcgauuacaugacgucuaugaagcgcuuuaaaaacgaauccgacccugagggcgcccucugguga

SEQ ID NO: 18484 - RNA, 9879 nt, Artificial Sequence
  derived and/or modified CDS sequence (opt5) from DENV-1__JN903581__SS-prME
agcgugaccaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuuucucuacacaagacgaaaagggggugacccagaacggacggcucaucacagcuaaucccaucgugacggauaaagagaagccuguuaacauugaaaccgagccgcccuuuggcgaguccuauaucgucauuggggccggagaaaaagcccugaagcugagcugguucaagaaaggcucuagcaucgggaagauguuugaggcuacagccagaggcgcucgccggauggccauucucggagacaccgcgugggauuucggcuccaucgggggaguguuuacaucugugggcaaacugguccaucagguguucgggaccgccuacggaguucuuuuuagcggcguguccuggacgaugaagaucgggauuggcauccugcucaccuggcugggacugaauagcagaaacacaucucuuuccaugaccuguauugcugucggcauggugacacucuaccuggggguuauggugcaggccgacaccggaugcgucaucaacuggaaaggccgcgaacugaagugugggagcggaauuuucgugacaaaugagguucacaccuggacggaacaauauaaguuucaggcugauucuccuaaacggcucuccgccgcgaucggcaaggccugggaggagggggugugcggcauuagaagcgcuacacgccuggaaaacaucauguggaaacagaucuccaaugagcuuaaccauauucugcucgaaaaugacaugaaguucaccgucguggugggagacgccaacggcauccugacccaggggaaaaagaugauucggccgcaacccauggagcacaaauacucuuggaaaagcuggggaaaggcuaagaucauuggcgccgauacacagaauaccacguuuaucaucgacgggccugauacacccgaauguccugacgaucagagagccuggaacauuugggaggucgaggacuauggauucggcaucuuuaccacaaauauuuggcugaaacuucgcgauuccuacacccagaugugcgaccaccggcucaugucugcuguuaucaaagauagcaaggcggugcaugccgacaugggcuauuggauugaauccgagaaaaacgaaacauggaagcuggcuagagccagcuucaucgaggugaagaccuguaucuggccccgcucucacacgcugugguccaaugggguccucgaaagcgagaugauuaucccgaaaauuuacggaggcccuaucucucaacauaacuaucggcccggguacuucacccagacagccggaccuuggcaccugggcaaacuugagcuggauuuuaaucucugcgaagggaccacagugguuguggacgagcacugcggaaacagaggccccucccugcggaccacgacagucaccggcaaaauuauccaugaaugguguugccgcagcuguacacugccuccccuuagauucagaggggaagauggaugcugguacggcauggagaucagaccggugaaggaagaggaagagaaucucguucgcucuauggugagcgcuggguccggagaagucgacagcuuuucucugggccugcucuguguguccauuaugaucgaggagguuaugaaaagccggugguccagaaagaugcugaugaccgggacccuugccguguucuuucugcucauuaugggacagcugacauggaacgaccugauccgccuuugcauuauggucggcgcgaacgugucugauagaaugggcauggggacgaccuaucuggcucucauggccacauucaagaugcggccuauguuugccgugggacuccuguuccgcagacugaccagccgggaaguccuucugcucacaaucggccugucccugguugcuucugccgagcuucccaauagccuggaggaacucggggacggacuggcgaugggcauuaugaugcucaaacugcuugcugauuuucaaucccaccagcuguggaccacgcuccugucucugacauucaucaagaccacccuuagccuggacuacgccuggaaaacaaucgccaugauucucuccaucgugagccuguuuccccucugucugucuaccacaucccagaagacgaccuggcuuccugugcugcuggggagcuucggaugcaaaccgcucacaauguuucugauuaccgaaaacaagaucuggggccgcaagucuuggccccuuaaugagggcauuauggcugucgggaucguguccauccugcucagcucucugcucaaaaacgauguuccucuggccggaccccuuauugcuggcgggaugcugaucgccuguuaugugauuuccggaagcuccgcggaccugagccucgagagagccgcugaagucucuugggaggaagaggccgaacauagcggcgcuucccacaauauccugguggagguucaggaugacgggacaaugaagauuaaagaugaggaacgggacgauacccuuacgauccugcucaaggccacccugcucgccaucucuggaguguacccuaugagcauucccgcuacacuguucgucugguauuucuggcagaagaagaaacagcgcuccggcgugcuuugggacaccccuucucccccggaggucgaaagagcggugcuggaugacggcaucuaccggauucugcagcgcgggcuccugggaagaagccagguuggcgugggggucuuucaagacggaguguuccauacaauguggcacguuacccggggcgccgugcuuauguaucaggggaagagacuggagccuuccugggcuucugucaagaaagaucucaucagcuacggaggcggcuggcgcuuucagggguccuggaacacaggagaggaagugcaagugauugccguugagcccggcaagaauccuaaaaacguccaaacgacccccgggacauucaagaccccggaaggagaggugggcgccaucgcucuggacuuuaaaccugggaccagcggaucucccauugugaaucgggaaggcaagaucgucggccucuacggggauggagugguuacaacguccggcaccuaugugagcgccaucgcgcaggcuaaggccucucaggaggggccucugcccgagauugaagacgaggucuucaaaaagagaaaccuuacaaucauggaucugcaccccggauccggcaaaacccgccgguaccugccugccauugugagagaagcuaucaagcgcaaacuccggacacugauucuugccccgaccagaguuguggcgagcgagauggcugaagcccugaaggggaugcccauccgcuaucaaacgacagccgucaaguccgagcauaccggccgggagaucguggaccucaugugccacgcuaccuuuacaaugagacugcugucuccuguucgggugcccaauuacaacaugauuaucauggaugaagcccauuucaccgacccugcuagcauugccgcgcgcggauauaucuccacaagagucggcaugggggaggccgcugccauuuuuaugaccgcuacgcccccuggaagcguggaagccuucccgcagucuaaugccgugauccaggaugaggaacgggacauccccgagcgcuccuggaacagcggcuacgauuggauuacagacuuuccugggaaaaccgucugguucguucccucuaucaagagcggaaaugacauugcuaacugucuccgcaagaacggcaagcgggugauccagcuuuccagaaaaacauucgauaccgaguaucaaaagacgaagaauaacgacugggauuacguggucaccacagacauuucugaaaugggggcgaauuuucgcgccgaucgggugaucgacccuagacgcugccuggagcccguuauucugaaagauggcccggaacgggugauccucgcuggaccuaugcccgucaccgccgccagcgcugcccagagacgcggccggaucgggagaaaccagaauaaggagggagaccaguacauuuauaugggccaaccccugaacaaugaugaggaccacgcgcauuggacagaagcuaaaaugcuucuggauaacaucaauaccccugaggggauuauccccgcccucuucgaaccugagcgcgaaaaguccgccgcuauugacggagaguacagacugcggggcgaggcccgcaaaacauuuguggaacugaugagaagaggggaucucccgguuuggcuuucuuauaagguggcgagcgagggcuuccaguacuccgaccgcagauggugcuuugacggagaacggaacaaucagguccuggaggaaaacauggauguggagaucuggaccaaggagggcgaacgcaagaagcugcgcccccgguggcucgacgccagaacguauagcgauccucuggcucuuagagaguucaaagaauuugccgcugggcggagaucugucuccggagaccugauccucgagauuggcaagcugccccagcaccugacacuccgggcccaaaaugcucuugauaaccuggugaugcugcacaauagcgaacaagggggaaaagccuaccgccaugcgauggaggagcucccugacaccaucgaaacccugaugcuucuggcccucauugcuguucugacaggcggcgugacccuguucuuucucuccgggaagggacuuggcaaaacaucuaucgggcugcugugugugauggccagcuccguccuccuguggauggcuucuguugagccccacuggauugccgccagcaucauccuugaguucuuucugauggugcuccugauuccggagccugauagacagcggacgccccaggacaaccaacuggcuuauguggucaucggacuccuuuucaugauucugaccguggcggccaacgagaugggccugcucgaaacaaccaagcgcgaucuggggaucggacauguuguggcugagaaucaccaccaugccacaaugcuugacauugaucugcacccugccuccgcuuggacccucuacgccgucgcgacgaccaucauuacacccaugaugagacauaccaucgaaaacacaaccgccaauaucagccugacggcuauugccaaccaggcugccauccugaugggccucgacaagggcuggccuauuucuaaaauggauaucggggugccccuucuggcgcugggaugcuacucccaggucaauccgcucacacugaccgccgcugugcuuaugcugguugcccacuaugcuauuaucggcccugggcuccaagccaaggcuacacgggaggcccagaaacgcaccgcggccggaaucaugaagaaccccaccguggacggcauugucgcuaucgaccuggaucccgugguuuacgacgccaaauuugaaaagcagcuggggcagauuaugcuccuuauccuguguacaagccaaauucugcucaugagaacgaccugggcucugugcgagucuaucacacuugccaccggaccucugacaacccucugggagggcuccccgggcaaguucuggaauacgacaaucgccgugagcauggcgaacauuuuccgggggucuuaucuggcuggagccggccuggcuuuuagccucaugaaaucccuugggggaggccgcagagggaccggagcccagggcgaaacccugggcgagaaguggaaacggcagcugaaucagcucucuaagagcgaguucaacacauacaaaagauccgggaucauggaggucgaucgcagcgaagccaaggagggacugaagcggggcgagaccacaaaacaugcuguguccagagggacggugaaacuucgcugguuuguugaacggaaucuggucaaacccgagggaaaggugauugaccucggcugugggagaggaggcuggucuuauuacugcgccggccugaaaaaggugaccgaagucaagggguauacaaaaggaggcccugggcacgaggaacccaucccuauggcgaccuacggauggaacauuguuaagcugcacagcggcaaagauguguucuuuacacccccugagaagugugacacccuccuuugcgauaucggggaguccucuccgaaucccacgauugaagagggacgcacccugcgggugcugaaaauggucgaaccuuggcucagaggcaaccaauucuguaucaagauccugaaucccuacaugccuagcgugguugagacacuugagcagaugcagcgcaaacauggcgggaugcuggugcggaacccccucuccagaaauucuacccacgaaauguauugggucagcugcggaacaggcaacauuguguccgccguuaacaugaccagccgcaugcugcugaaucgguuuacaauggcucauagaaagccgaccuacgagcgcgacguggaucucggggccggaacgagacacgucgcuguggaaccugagaucgccaaccuggacauuaucggccagcggauugaaaauaucaagaacgagcacaaaucuacauggcauuaugaugaggacaaucccuacaagaccugggcguaucacggguccuacgaagugaaacccagcggaucugccuccagcauggucaacggcguugugcgccuucugaccaagccuugggacgugauccccauggucacacaaauugcuaugacggauaccacaccuuucggccagcagagaguguuuaaagagaagguugacacccggacaccgagacccaagcgggggaccgcccaaaucauggaagugacagcuaaauggcucuggggauuccugucucgcaauaagaaaccuagaauuuguacccgggaggaauuuacgcgcaaggucagauccaacgccgcuaucggcgccguguucguugaugagaaucaguggaacagcgcgaaagaggccguggaagacgagcgguuuugggaucuuguccaucgcgaaagagagcugcacaagcaggggaagugcgcuaccugcguguauaauaugaugggaaaacgggaaaagaaacucggcgaguucgggaaggccaaaggcucccgcgcuauuugguacauguggcugggagccagauuccuggaguuugaagcccucggcuucaugaacgaggaccauugguuuagccgggaaaauucucugagcgggguugagggagagggccuuuacaagcugggguauauccuccgcgauaucuccaagauucccggaggcaacauguacgcggacgauacagcugggugggacaccagaaucacagaagaugaccugcagaaugaggccaaaauuaccgauaucauggaaccugagcacgcccuucuggcuacgucuauuuucaagcucacauaucaaaacaaagugguccgggugcagcgccccgccaagagcggcaccgucauggacgugaucuccagacgggaccagagaggaucuggccagguugggacauacggacugaacaccuuuacgaauauggaagugcaacugauccgccagauggagagcgagggcauuuucuccccgucugaacucgagaacagcaaucuggcugaacggguccuugauuggcuggagaaacacgggguggaaagacucaagcgcauggccaucuccggagacgauugugugguuaaaccuaccgacgaucgguuugcgacagcccugaccgcucuuaacgacaugggcaaggugagaaaggauauuccccagugggagccuagcaaaggguggaaugacuggcagcaaguccccuucugcucucaucacuuucaucagcugaucaugaaggauggccgcgagauugugguuccuugucggaaccaggacgaacucgugggacgggcccgcgucucccagggcgcuggguggagccugcgggagacagccugccugggaaaaucuuaugcgcaaauguggcagcucauguacuuccacagacgcgaucugcggcuugccgcuaaugccaucuguuccgcugugcccgucaacugggugccgaccagcagaacaaccugguccauucacgcccaucaccaguggaugacgacagaagacaugcugucuguuuggaaucggguguggaucgaggaaaacccuuggauggaggacaagacccaugucagcuccugggaggaugugcccuaucucggcaaaagagaagaccaauggugcgggagccugaucggacuuaccgcucgcgccacaugggcgaccaauauucagguugccaucaaccaggugcggagacugauuggcaaugagaacuacucugauuacaugacauccaugaagcgcuuuaagaaugaaagcgaccccgagggggcucucugguga

SEQ ID NO: 18485 - RNA, 9879 nt, Artificial Sequence
  derived and/or modified CDS sequence (opt5) from DENV-1__KX380796__SS-prME
agcgugaccaugcugcucaugcugcuucccaccgcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagaugcagaaaguugaaacaugggcucuuagacaccccggcuucaccgugauugcccuguuucucgcgcaugccaucgggacaucuauuacccagaagggaaucaucuucauucugcuuaugcuggucaccccuagcauggcuaugagaugcgugggcaucgggaaccgggauuuuguugagggacucuccggcgccacauggguggacgucgugcuggagcacgggagcugugugacgaccauggcuaagaauaaacccacacuggauauugaacuccugaagaccgaggucacaaacccugccguucuucgcaaacugugcaucgaagcgaagauuucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagacgguucaguacgaaaaccugaaauauucugugaucgucaccgugcacacaggcgaucagcaucaaguugggaaugagaccacagaacacggaaccauugcuacgaucacaccccaagccccuacauccgagauccagcugaccgacuacggcgcccucacacuggacuguagcccccggaccggccuugauuucaacgaaauggugcugcucacgaugaaggagaaaucuuggcugguccauaagcagugguuucuugaccugccucuccccuggacauccggggcuagcaccucccaagagacauggaaucgccaggaucugcuggugaccuucaaaaccgcgcacgccaagaagcaggaagucgugguucucggaucucaagagggcgcuaugcacacagcccugacgggggccaccgaaauucagacaagcggaaccacaaccaucuuugcuggccaucuuaaaugcagacugaagauggacaaacucacgcugaaggggguguccuaugucauguguacaggcagcuucaaacuggagaaggaaguggccgagacccagcacggaaccguucuugugcaggucaaguacgagggcacagaugcgccgugcaaaauuccuuucucuacccaagacgaaaagggggugacacagaacggacggcucaucacggcuaaucccauugugaccgauaaagagaagccuguuaacaucgaaacagagccgcccuuuggcgaguccuauaucgucauuggggccggagaaaaagcccugaagcugagcugguucaagaaaggcucuagcaucgggaagauguuugaggcuaccgccagaggcgcucgccggauggccauucucggagacacagcgugggauuucggcuccaucgggggaguguuuaccucugugggcaaacugguccaucagguguucgggacggccuacggaguucuuuuuaauggcgugagcuggaccaugaagauugggaucggcauccugcucacauggcugggacugaacuccagaagcaccucucuuuccaugacauguauugcugucggcauggugacccucuaccuggggguuauggugcaggccgacagcggaugcgucaucaacuggaaaggccgcgaacugaagugugggucuggaauuuucgugacaaaugagguucacaccuggacggaacaauauaaguuucaggcugauuccccuaaacggcucagcgccgcgaucggcaaggccugggaggagggggugugcggcauuagauccgcuacacgccuggaaaacaucauguggaaacagauuucuaaugagcuuaaccauauccugcucgaaaaugacaugaaguucaccgucguggugggagacgccaacggcauccugacccaggggaaaaagaugauucggccgcaacccauggagcacaaauacagcuggaaguccuggggaaaggcuaaaaucauuggcgccgauacacagaauaccacguuuaucauugacgggccugauacacccgaauguccugacgaucagagagccuggaacaucugggaggucgaggacuauggauucggcguuuuuaccacaaauaucuggcugaaacuucgcgauucuuacacccagaugugcgaccaccggcucaugagcgcugcgauuaaagauuccaaggccgugcaugcugacaugggcuauuggaucgaaagcgagaaaaacgaaacauggaagcuggccagagccucuuucauugaggugaagaccuguaucuggccccgcucccacacgcuguggagcaaugggguccucgaaucugagaugauuaucccgaaaaucuacggaggcccuauuucccaacauaacuaucggcccggguacuucacccagacagcuggaccuuggcaccugggcaaacuugagcuggauuuugaccucugcgaagggaccacagugguuguggaugagcacugcggaaauagaggccccagccugcggaccacgacagucaccggcaaaaucauucaugaaugguguugccgcucuuguacacugccuccccuuagauucagaggggaagacggaugcugguacggcauggagauccggccggugaaggaaaaagaggaaaaccucguucgcagcaugguguccgccgggagcggagaggucgacucuuuuucccugggccugcucugugugagcauuaugaucgaagagguuaugcgguccagauggucucgcaagaugcugaugaccgggacccuugcgguguucuuucugcucaucaugggacagcugacauggaaugaucugauuagacuuugcaucauggucggcgcuaacgugagcgaccggaugggcauggggacgaccuaucuggcccucauggccacauucaagaugcgcccuauguuugcugugggacuccuguucagacggcugaccucccgcgagguccuucugcucacaauuggccugucucugguugccagcguggaacuucccaacucccuggaggaacucggggauggacuggcgaugggcaucaugaugcucaaacugcuuaccgacuuucaaccccaccagcuguggacgacacuccugucucugaccuucauuaagaccacacuuagccuggauuacgcuuggaaaaccauggccauggugcucuccaucgucagccuguuuccucucugucugucuacaacgucccagaagaccacauggcuuccggugcugcuggggagcuucggaugcaaaccccucaccauguuucugauuacagagaauaagaucuggggcagaaagucuuggccucuuaacgaaggcaucauggccguugggauuguguccauccugcucagcucucugcucaaaaaugacgucccccuggcuggaccucuuauugccggcgggaugcugaucgcuuguuaugugauuuccggaagcuccgccgaucugagccucgagcgggcggccgagguuucuugggaagaggaagcugagcauagcggcgccucccacaacauccugguggaaguccaggacgaugggaccaugaagaucaaagacgaggagcgcgaugacacgcuuaccauucugcucaaggcuacacugcucgccgugucuggagucuaccccaugagcaucccugccacccuguucgugugguauuucuggcagaagaagaaacagagauccggcguucuuugggauacacccucuccgccugaaguggagcgggcuguccuggacgacggcauuuaccgcauccugcagagagggcuccugggacggagccaggugggcguugggguguuucaagauggagucuuccauaccauguggcacgugacaagaggcgcggugcuuauguaucaggggaaacgccuggaacccuccugggccucuguuaagaaagaccucauuagcuacggaggcggcuggcgguuucagggguccuggaauacgggagaggagguccaggugaucgcuguggaaccuggcaagaaccccaaaaauguccaaaccacaccggggaccuucaagaccccugagggagaagugggcgccaucgcccuggauuuuaaacccgggacaagcggaucuccuauuguuaacagagagggcaagaucgugggccucuacgggaauggagucgugacgaccuccggcacauauguuagcgcuauugcccaggcgaaggcuucucaggaagggccccugcccgagaucgaggacgaaguguucaaaaagcgcaaccuuaccauuauggaucugcacccuggauccggcaaaacacggagauaccugccggccaucguccgcgaggccauuaagcggaaacucagaacccugauccuugcucccacgcgcgugguugccagcgaaauggcggaggcucugaaggggaugccuauccgguaucaaacaaccgccgugaaguccgaacauaccggcaaagagauugucgaccucaugugccacgccacauuuaccaugagacugcugucucccgugcgggugccuaauuacaacaugaucauuauggaugaggcucauuucacagaccccgccagcaucgcugcccgcggauauauuuccaccagagucggcaugggggaagcggccgcuaucuuuaugacggccacaccuccgggaagcguugaggcuuucccccagucuaaugccgugauccaggaugaagaacgggacauuccugaacgcuccuggaacagcggcuacgauuggaucaccgacuuucccgggaagacagugugguucgucccuucuauuaaaagcggaaaugacaucgccaacugucucagaaagaacggcaaacgggugauucagcuuuccagaaagaccuucgauacggaguaucaaaagaccaaaaauaacgacugggauuacguugugacaaccgacaucucugagaugggggcuaauuuucgcgcggaucgggucaucgaccccagacgcugccugaagccggugauucugaaagauggcccugaacggguuauccucgccggacccaugcccgugacagcugccagcgccgcucagagacgcggccggauugggagaaaccagaauaaggagggagaccaguacaucuauaugggccaaccucugaacaaugaugaagaccacgcccauuggaccgaggcgaaaaugcuucuggauaacauuaauacacccgaggggaucauuccugcucucuucgaaccggagcgcgaaaaguccgccgccaucgacggagaguacagacugcggggcgaagcucgcaagaccuuugucgagcugaugagaagaggggaucuccccguguggcuuucuuauaaagucgccagcgagggcuuccaguacuccgaccgcagauggugcuuugacggagaacggaacaaucaggugcuggaggaaaacauggauguugagaucuggacgaaggaaggcgagcgcaagaagcugcgcccucgguggcucgacgcgagaacauauagcgauccccuggcccuucgcgaguucaaagaauuugcugccgggcggagaucuguguccggagaccugauucucgagaucggcaagcugccucagcaccugacccuccgggcucaaaaugcccuugauaaccuggugaugcugcacaauagcgaacaagggggaaaggcuuaccgccaugccauggaggaacuccccgacaccauugagacacugaugcuucuggcgcucaucgccguccugaccggcggcguuacacuguucuuucucuccgggaagggacuuggcaagacgucuauugggcugcugugugugauggcuagcuccgugcuccuguggauggccucugucgagccgcacuggaucgcugccagcaucauucuugaguucuuucugauggugcuccugaucccugagcccgauagacagcggaccccucaggacaaccaacuggccuauguugugauuggacuccuuuucaugauccugacagucgcugcgaacgaaaugggccugcucgagaccaccaagaaggaucuggggauuggacauguggucgccgagaaucaccaccaugcuaccaugcuugacaucgaucugcaccccgccuccgccuggacgcucuacgcuguggccaccacaaucauuaccccuaugaugcgccauacaaucgaaaacaccacggcgaauauuagccugacagccaucgcuaaccaggccgcuauucugaugggccucgacaaaggcuggcccaucucuaagauggauauugggguuccgcuucuggcccugggaugcuacucccaggugaauccucucacccugacagcggccguccuuaugcugguggcucacuaugccaucaucggccccgggcuccaagcuaaagccaccagagaggcucagaagcggaccgccgcgggaauuaugaagaaccccacaguugacggcaucguggccauugaccuggauccugucguguacgacgcuaaauuugaaaagcagcuggggcagaucaugcuccuuauucuguguacgagccaaauccugcucaugcgcaccacaugggcccugugcgagucuaucacccuugcuacaggaccgcugaccacgcucugggaaggcucccccggcagauucuggaauacaaccauugccgugagcauggccaacaucuuccgggggucuuaucuggcgggagcuggccuggccuuuagccucaugaaaucccuugggggaggccgcagagggaccggagcucagggcgagacacugggcgagaaguggaaacggcagcugaaucagcucucuaagagcgaguucaacaccuacaagagauccgggauuauggagguugaucgcagcgaagccaaagagggacugaagcggggcgaaacaacgaaacaugccgucuccagagggaccgcuaaacuucgcugguuuguggagcggaaucuggugaaaccugagggaaaggucaucgaccucggcugugggagaggaggcuggucuuauuacugcgccggccugaagaaaguuacagaagugaagggguauaccaaaggaggccccgggcacgaggaaccuauucccauggcgacauacggauggaacaucgugaagcugcacagcggccgcgaugucuucuuuaccccuccggagaaaugugacacgcuccuuugcgauaucggggaauccucucccaauccuaccauugaggagggacggacacugagagugcugaagaugguugaacccuggcuccgcggcaaccaauucuguaucaaaauucugaauccuuacaugcccagcguggucgagacccuugaacagaugcagcggaagcauggcgggaugcuggugagaaacccgcucucccgcaauucuacacacgagauguauuggguuagcugcggaaccggcaacaucguguccgccgucaacaugacaagccggaugcugcugaauagauuuaccauggcucaucgcaagccuacguacgagagagacguggaucucggggccggaacacggcacguggcugucgaacccgagauugccaaccuggacaucauuggccagcgcaucgaaaauaucaaaaacgagcacaagucuaccuggcauuaugaugaagacaaucccuacaaaaccugggcguaucacggguccuacgagguuaagccuagcggaucugccuccagcauggugaacggcguggucagacuucugacaaaacccugggacgugauuccuaugguuacgcaaaucgcuaugaccgauacaaccccguucggccagcagcggguguuuaaggagaaggucgacacaagaacaccccggccuaaacgcgggacagcccaaauuauggaagugaccgcuaaguggcucuggggauuccugucuagaaauaaaaagccccggaucuguacgcgcgaggaauuuaccagaaaaguucgguccaacgccgcuauuggcgccguguucgucgaugagaaucaguggaacagcgcgaaggaagccguggaggacgagcgcuuuugggaucuuguucauagagaacgggagcugcacaagcaggggaaaugcgcuacaugcguguauaauaugaugggaaagcgcgagaaaaagcucggcgaguucgggaaagccaagggcuccagagcuaucugguacauguggcugggagcccgguuccuggaauuugaggcccucggcuucaugaacgaggaccauugguuuagccgcgaaaauucucugagcggggucgagggagaaggccuucacaagcugggguacauccucagagauauuuccaaaaucccuggaggcaacauguaugcggacgauaccgcugggugggacacacggauuaccgaggaugaccugcagaaugaggccaagaucacggauauuauggaacccgagcacgcccuucuggcuacaucuaucuucaaacucaccuaccaaaacaaggugguccgcgugcagagaccggccaaaagcggcacaguuauggacgugaucucccggagagaccagcgcggaucuggccaggucgggaccuauggacugaacacguuuaccaauauggaagugcaacugauucggcagauggagagcgaaggcaucuucuccccuucugagcucgagaacagcaaucuggcugaaagagugcuugauuggcuggagaagcaugggguugaacgccucaaacggauggccauuuccggagacgauuguguggucaagcccacagacgauagauuugcgaccgcccugacagcucuuaacgacaugggcaaggugcgcaaagauaucccucagugggagcccagcaagggguggaaugacuggcagcaaguuccuuucugcucucaccauuuucaccagcugauuaugaaagauggccgggaaaucgugguccccuguagaaaccaggacgagcucgugggacgcgcccgggucucccagggcgcuggguggagccugagagagaccgccugccugggaaagucuuacgcgcaaauguggcagcucauguauuuccaccgccgggaucugagacuugccgcuaaugccaucuguuccgcugugccgguuaacugggugccuacaagccggaccacgugguccauucaugcccaccaucaguggaugacaaccgaagacaugcugucugucuggaauagaguguggaucgaggaaaaccccuggauggaggacaaaacccacguuagcuccugggaagaugugcccuaccucggcaagcgcgaggaccaauggugcgggagccugauuggacuuacagcucgggccaccugggcgacaaauauccaggucgccauuaaccaggugagacgccugaucggcaaugagaacuaucucgauuacaugacgucuaugaagagauuuaaaaaugaauccgacccugagggggcucugugguga

SEQ ID NO: 18486 - RNA, 9879 nt, Artificial Sequence
  derived and/or modified CDS sequence (opt5) from DENV-1__KX380799__SS-prME
agcgugaccaugcugcucaugcugcuucccacagcccuggcuuuccaccucacgacccggggcggggaaccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagauccggccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgguguuuuuccugcucauuaugggacagcugaccuggaaugaccugaucagacuuugcauuauggucggcgcuaacguguccgaucggaugggcauggggacaacguaucuggcccucauggccaccuuuaagaugcgcccuauguucgcugugggacugcucuuuagacggcugacaucucgcgagguccuucugcucaccaucggccugagccugguugccuccguggaacuucccaacucucuggaggaacucggggacggacuggcgaugggcauuaugaugcucaaacugcuuacagauuuccaaagccaccagcuguggaccacgcuccugucccugacauuuaucaagaccacccuuagccuggacuacgcuuggaaaacaauggccauggugcucucuaucgucucccuguucccccucugucugagcaccacaucucagaagacgaccuggcuuccugugcugcugggguccuuuggaugcaaaccgcucacaauguuccugauuaccgagaauaagaucuggggcagaaagagcuggccccuuaacgaaggcauuauggccguugggaucgugucuauucugcucuccagccugcucaaaaaugaugucccucuggcuggaccccuuaucgccggcgggaugcugaucgcuuguuaugugauuuccggaagcucugccgaccugagccucgagcgggcggccgagguuuccugggaagaggaagcugagcauucuggcgccagccacaacauccugguggaaguccaggaugacgggacaaugaagauuaaagaugaggagcgcgacgauacccuuacgauccugcucaaggcuacccugcucgccguguccggagucuacccuaugucuauucccgccacacuguuugugugguauuucuggcagaagaagaaacagagaagcggcguucuuugggacaccccuagcccucccgaaguggagcgggcuguccuggaugacggcaucuaccgcauccugcagagagggcuccugggacggucucaggugggcguugggguguuccaagacggagucuuucauacaauguggcacgugaccagaggcgcggugcuuauguaucaggggaaacgccuggaacccagcugggccuccguuaagaaagaucucauuagcuacggaggcggcuggcgguuccaggggucuuggaauacaggagaggagguccaggugaucgcuguggaacccggcaagaacccuaaaaauguccaaacgacccccgggacauuuaagaccccggagggagaagugggcgccauugcccuggacuucaaaccugggaccuccggaagccccaucguuaacagagagggcaagauugugggccucuacgggaauggagucgugacaacgucuggcaccuauguuuccgcuaucgcccaggcgaaggcuagccaggaagggccucugcccgagauugaggaugaaguguuuaaaaagcgcaaccuuacaaucauggaccugcaccccggauccggcaaaacccggagauaccugccugccaucguccgcgaggccauuaagcggaaacucagaacacugauccuugcuccgacccgcgugguugccucugaaauggcggaggcucugaaggggaugcccauucgguaucaaacgacagccgugaaguccgaacauaccggcaaagagaucgucgaucucaugugccacgccaccuucacaaugagacugcuguccccugugcgggugcccaauuacaacaugauuaucauggacgaggcucauuuuaccgauccugccagcaucgcugcccgcggauauauuucuacaagagucggcaugggggaagcggccgcuaucuucaugaccgccacgcccccuggauccguugaggcuuuuccgcagagcaaugccgugauucaggacgaagaacgggauauccccgaacgcucuuggaacagcggcuacgacuggauuacagauuucccugggaagaccgugugguuuguccccuccaucaaaucuggaaaugacaucgccaacugucucagaaagaacggcaaacgggugauucagcuuagcagaaagacauucgacaccgaguaucaaaagacgaaaaauaacgauugggacuacguugugaccacagauaucuccgagaugggggcuaauuuccgcgcggaccgggucauugauccuagacgcugccugaagcccgugauccugaaagacggcccggaacggguuauucucgccggaccuaugcccgugaccgcugccucugccgcucagagacgcggccggaucgggagaaaccagaauaaggagggagaucaguacauuuauaugggccaaccccugaacaaugacgaagaucacgcccauuggacagaggcgaaaaugcuucuggacaacaucaauaccccugaggggaucauucccgcucucuuugaaccugagcgcgaaaagagcgccgccaucgauggagaguacagacugcggggcgaagcucgcaagacauucgucgagcugaugagaagaggggaccucccgguguggcuuuccuauaaagucgccagcgagggcuuucaguacucugaucgcagauggugcuucgacggagaacggaacaaucaggugcuggaggaaaacauggacguugagauuuggaccaaggaaggcgagcgcaagaagcugcgcccccgguggcucgaugcgagaacguauuccgacccucuggcccuucgcgaguuuaaagaguucgcugccgggcggagaagcguguccggagaucugauccucgagauuggcaagcugccccagcaccugacacuccgggcucaaaaugcccuugacaaccuggugaugcugcacaauucugaacaagggggaaaggcuuaccgccaugccauggaggaacucccugauaccaucgagacccugaugcuucuggcgcucaucgccguccugacaggcggcguuacccuguuuuuccucagcgggaagggacuuggcaagacauccauugggcugcugugugugauggcuucuagcgugcuccuguggauggccuccgucgagccccacuggaucgcugccagcauuauccuugaauuuuuccugauggugcuccugauuccggagccugacagacagcggacgccccaggauaaccaacuggccuauguugugaucggacuccuuuuuaugauccugaccgucgcugcgaacgaaaugggccugcucgagacaaccaaaaaggaccuggggauuggacauguggucgccgagaaucaccaccaugcuacaaugcuugauaucgaccugcacccugccucugccuggacccucuacgcuguggccacgaccauuaucacacccaugaugcgccauaccauugaaaacacaaccgcgaauaucucccugacggccauugcuaaccaggccgcuauccugaugggccucgauaaaggcuggccuaucagcaagauggacauugggguuccccuucuggcccugggaugcuacucucaggugaauccgcucacacugaccgcggccguccuuaugcugguggcucacuaugccaucauuggcccugggcuccaagcuaaagccacaagagaggcucagaagcggaccgccgcgggaaucaugaagaaccccaccguugauggcauuguggccaucgaccuggaccccgucguguacgaugcuaaauucgaaaagcagcuggggcagaucaugcuccuuauucuguguacaucccaaauccugcucaugcgcacgaccugggcccugugcgagagcauuacacuugcuaccggaccucugacaacccucugggaaggcucuccgggcagauuuuggaauacgacaaucgccgugagcauggccaacauuuuccggggguccuaucuggcgggagcuggccuggccuucucucucaugaaaagccuugggggaggccgcagagggaccggagcucagggcgagacccugggcgagaaguggaaacggcagcugaaucagcucuccaagagcgaauuuaacacauacaagagauccgggaucauggagguugaccgcucugaagccaaagagggacugaagcggggcgaaaccacaaaacaugccgucagcagagggacggcuaaacuucgcugguucguggagcggaaucuggugaaacccgagggaaaggucaucgaucucggcugugggagaggaggcugguccuauuacugcgccggccugaagaaaguuaccgaagugaagggguauacaaaaggaggcccugggcacgaggaacccauuccuauggcgaccuacggauggaacaucgugaagcugcacucuggccgcgacgucuuuuucacacccccugagaaaugugauacccuccuuugcgacauuggggaaagcuccccgaaucccacgaucgaggagggacggacccugagagugcugaagaugguugaaccuuggcuccgcggcaaccaauuuuguauuaaaauccugaaucccuacaugccuucuguggucgagacacuugaacagaugcagcggaagcauggcgggaugcuggugagaaacccccucagccgcaauuccacccacgagauguauuggguuagcugcggaacaggcaacauugugucugccgucaacaugaccucccggaugcugcugaauagauucacaauggcucaucgcaagccgaccuacgagagagauguggaccucggggccggaacgcggcacguggcugucgaaccugagaucgccaaccuggauaucauuggccagcgcaucgaaaauauuaaaaacgagcacaagagcacauggcauuaugacgaagauaaucccuacaaaaccugggcguaucacgggucuuacgagguuaagcccuccggaagcgccucuuccauggugaacggcguggucagacuucugaccaaaccuugggacgugauccccaugguuacacaaauugcuaugacggacaccacaccuuuuggccagcagcggguguucaaggagaaggucgauaccagaacaccgcggcccaaacgcgggaccgcccaaaucauggaagugacagcuaaguggcucuggggauuucugagcagaaauaaaaagccucggaucuguacccgcgaggaguucacgagaaaaguucgguccaacgccgcuauuggcgccguguuugucgacgagaaucaguggaacagcgcgaaggaagccguggaggaugagcgcuucugggaccuuguucauagagaacgggagcugcacaagcaggggaaaugcgcuaccugcguguauaauaugaugggaaagcgcgagaagaagcucggcgaguuugggaaagccaagggcucuagagcuaucugguacauguggcugggagcccgguuccuggaguucgaggcccucggcuuuaugaacgaggaucauugguucagccgcgaaaauucccugucuggggucgagggagaaggccuucacaagcugggguacauucucagagacaucagcaaaauucccggaggcaacauguaugcggaugacacagcugggugggauacccggaucacagaggacgaucugcagaaugaggccaagaucaccgacauuauggaaccugagcacgcccuucuggcuacguccaucuuuaaacucacauaccaaaacaaggugguccgcgugcagagacccgccaaaucuggcaccguuauggaugugauuagccggagagaccagcgcggauccggccaggucgggacauauggacugaacaccuucacgaauauggaagugcaacugauccggcagauggagucugaaggcauuuuuagcccguccgagcucgagaacagcaaucuggcugaaagagugcuugacuggcuggagaagcaugggguugaacgccucaaacggauggccaucucuggagaugacuguguggucaagccuaccgaugacagauucgcgacagcccugaccgcucuuaacgauaugggcaaggugcgcaaagacaucccccagugggagccuuccaagggguggaaugauuggcagcaaguucccuuuugcagccaccauuuccaccagcugauuaugaaagacggccgggaaaucguggucccuuguagaaaccaggaugagcucgugggacgcgcccgggucucucagggcgcuggguggucccugagagagacagccugccugggaaagagcuacgcgcaaauguggcagcucauguauuuucaccgccgggaccugagacuugccgcuaaugccauuuguuccgcugugcccguuaacugggugccgaccucucggacaaccuggagcauccaugcccaccaucaguggaugacgacagaagauaugcuguccgucuggaauagaguguggauugaggaaaacccuuggauggaggacaaaacccacguuagcucuugggaagacgugcccuaccucggcaagcgcgaggaucaauggugcgggucccugaucggacuuaccgcucgggccacaugggcgaccaauauucaggucgccaucaaccaggugagacgccugaucggcaaugagaacuaucucgacuacaugacaagcaugaagagauucaaaaaugaaucugaucccgagggggcucugugguga

SEQ ID NO: 18487 - RNA, 9879 nt, Artificial Sequence
  derived and/or modified CDS sequence (opt5) from DENV-1__KX380800__SS-prME
agcgugaccaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcauuacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuguguguccauuaugaucgaagagguuaugcggucuagauggagccgcaagaugcugaugacagggacccuugcgaucuuuuuccugcucaucaugggacagcugaccuggaaugaccugauuagacuuugcaucauggugggcgcuaacgucuccgaucggaugggcauggggacaacguaucuggcccucauggccaccuuuaagaugcgcccuauguucgcugugggacugcucuuuagacggcugacaucucgcgaggugcuucugcucaccauuggccugagccuggucgccuccguugaacuucccaacucucuggaggaacucggggacggacuggcgaugggcaucaugaugcucaaacugcuuacagauuuccaaagccaccagcuguggaccacgcuccugucccugacauuuaucaagaccacccuuagccuggacuacgcuuggaaaacaauggccauggugcucucuauugugucccuguucccccucugucugagcaccacaucucagaagacgaccuggcuuccuguccugcugggguccuuuggaugcaaaccgcucacaauguuccugaucaccgagaauaagauuuggggcagaaagagcuggccccuuaacgaaggcaucauggccguggggauuguuucuauccugcucuccagccugcucaaaaaugaugugccucuggcuggaccccuuaucgccggcgggaugcugauugcuuguuaugucaucuccggaagcucugccgaccugagccucgagcgggcggccgagguguccugggaagaggaagcugagcauucuggcgccagccacaacauucugguugaagugcaggaugacgggacaaugaagaucaaagaugaggagcgcgacgauacccuuacgauucugcucaaggcuacccugcucgccgucuccggaguguacccuaugucuauccccgccacacuguuugucugguauuucuggcagaagaagaaacagagaagcggcgugcuuugggacaccccuagcccucccgaaguugagcgggcugugcuggaugacggcaucuaccgcauucugcagagagggcuccugggacggucucaggucggcguggggguuuuccaagacggaguguuucauacaauguggcacgucaccagaggcgcggugcuuauguaucaggggaaacgccuggaacccagcugggccuccgugaagaaagaucucaucagcuacggaggcggcuggcgguuccaggggucuuggaauacaggagaggagguucaggucauugcuguggaacccggcaagaacccuaaaaaugugcaaacgacccccgggacauuuaagaccccggagggagaagucggcgccaucgcccuggacuucaaaccugggaccuccggaagccccauugugaacagagagggcaagaucguuggccucuacgggaauggaguggucacaacgucuggcaccuauguguccgcuauugcccaggcgaaggcuagccaggaagggccucugcccgagaucgaggaugaaguuuuuaaaaagcgcaaccuuacaaucauggaccugcaccccggauccggcaaaacccggagauaccugccugccauugugcgcgaggccaucaagcggaaacucagaacacugauucuugcuccgacccgcgucguggccucugaaauggcggaggcucugaaggggaugcccauccgguaucaaacgacagccguuaagagcgaacauaccggcaaagagauuguggaucucaugugccacgccaccuucacaaugagacugcuguccccuguccgggugcccaauuacaacaugaucaucauggacgaggcucauuuuaccgauccugccagcauugcugcccgcggauauaucucuacaagagugggcaugggggaagcggccgcuauuuucaugaccgccacgcccccuggauccgucgaggcuuuuccgcagagcaaugccguuauccaggacgaagaacgggauauucccgaacgcucuuggaacagcggcuacgacuggaucacagauuucccugggaagaccgugugguuugugcccuccaucaaaucuggaaaugacauugccaacugucucagaaagaacggcaaacgggucauccagcuuagcagaaagacauucgacaccgaguaucaaaagacgaaaaauaacgauugggacuacgugguuaccacagauauuuccgagaugggggcuaauuuccgcgcggaccgggugaucgauccuagacgcugccugaagcccgucauucugaaagacggcccggaacgggugauccucgccggaccuaugcccguuaccgcugccucugccgcucagagacgcggccggauugggagaaaccagaauaaggagggagaucaguacaucuauaugggccaaccccugaacaaugacgaagaucacgcccauuggacagaggcgaaaaugcuucuggacaacaucaauaccccugaggggauuauccccgcucucuuugaaccugagcgcgaaaagagcgccgccauugauggagaguacagacugcggggcgaagcucgcaagacauucguggagcugaugagaagaggggaccucccggucuggcuuuccuauaaaguggccagcgagggcuuucaguacucugaucgcagauggugcuucgacggagaacggaacaaucagguccuggaggaaaacauggacguggagaucuggaccaaggaaggcgagcgcaagaagcugcgcccccgguggcucgaugcgagaacguauuccgacccucuggcccuucgcgaguuuaaagaguucgcugccgggcggagaagcguuuccggagaucugauucucgagaucggcaagcugccccagcaccugacacuccgggcucaaaaugcccuugacaaccuggugaugcugcacaauucugaacaagggggaaaggcuuaccgccaugccauggaggaacucccugauaccaucgagacccugaugcuucuggcgcucauugccgugcugacaggcggcgucacccuguuuuuccucagcgggaagggacuuggcaagacauccaucgggcugcuguguguuauggcuucuagcgugcuccuguggauggccuccguggagccccacuggauugcugccagcaucauucuugaauuuuuccugaugguccuccugaucccggagccugacagacagcggacgccccaggauaaccaacuggccuaugugguuaucggacuccuuuuuaugauucugaccguggcugcgaacgaaaugggccugcucgagacaaccaaaaaggaccuggggaucggacaugucguggccgagaaucaccaccaugcuacaaugcuugauauugaccugcacccugccucugccuggacccucuacgcugucgccacgaccaucauuacacccaugaugcgccauaccaucgaaaacacaaccgcgaauauuucccugacggccaucgcuaaccaggccgcuauccugaugggccucgauaaaggcuggccuauuagcaagauggacaucggggugccccuucuggcccugggaugcuacucucagguuaauccgcucacacugaccgcggccgugcuuaugcuggucgcucacuaugccauuaucggcccugggcuccaagcuaaagccacaagagaggcucagaagcggaccgccgcgggaauuaugaagaaccccaccguggauggcaucguugccaucgaccuggaccccguggucuacgaugcuaaauucgaaaagcagcuggggcagauuaugcuccuuauccuguguacaucccaaauucugcucaugcgcacgaccugggcccugugcgagagcaucacacuugcuaccggaccucugacaacccucugggaaggcucuccgggcaaauuuuggaauacgacaauugccgugagcauggccaacaucuucagaggguccuaucuggcgggagcuggccuggccuucucucucaugaagucccuugggggaggccggcgcgggaccggagcucagggcgagacccugggcgagaaauggaagagacagcugaaucagcucuccaagagcgaauuuaacacauacaaacgguccgggaucauggagguggacagaucugaagccaaggagggacugaaacgcggcgaaaccacaaagcaugccguuagccgggggacggcuaaacuuagaugguucgucgagcgcaaucuggugaagcccgagggaaaggugauugaucucggcugugggcggggaggcugguccuauuacugcgccggccugaaaaaggucaccgaaguuaaaggguauacaaagggaggcccugggcacgaggaacccaucccuauggcgaccuacggauggaacauugugaaacugcacucuggcagagacguguuuuucacacccccugagaagugugauacccuccuuugcgacaucggggaaagcuccccgaaucccacgauugaggagggacgcacccugcggguccugaaaaugguggaaccuuggcucagaggcaaccaauuuuguaucaagauucugaaucccuacaugccuucuguuguggagacacuugaacagaugcagcgcaagcauggcgggaugcugguccggaacccccucagcagaaauuccacccacgagauguauugggugagcugcggaacaggcaacaucguuucugccgugaacaugaccucccgcaugcugcugaaucgguucacaauggcucauagaaaaccgaccuacgagcgcgaugucgaccucggggccggaacgagacacguggcuguggaaccugagaucgccaaccuggauauuaucggccagcggauugaaaauaucaagaacgagcacaaaagcacauggcauuaugacgaagauaaucccuacaagaccugggcguaucacgggucuuacgaggucaaacccuccggaagcgccucuuccaugguuaacggcguggugcgccuucugaccaagccuugggacgucauucccauggugacacaaaucgcuaugacggacaccacaccuuuuggccagcagagaguuuucaaggagaaaguggauacccggacaccgagacccaagcgggggaccgcccaaaucauggaagucacagcuaaauggcucuggggauuucugagccgcaauaagaaaccuagaauuuguacccgggaggaguucacgcgcaaggugagauccaacgccgcuaucggcgccguuuuuguggacgagaaucaguggaacagcgcgaaggaagccgucgaggaugagcgguucugggaccuugugcaucgcgaaagagagcugcacaaacaggggaagugcgcuaccugcguuuauaauaugaugggaaaacgggaaaagaaacucggcgaguuugggaaggccaagggcucucgcgcuauuugguacauguggcugggagccagauuccuggaguucgaggcccucggcuuuaugaacgaggaucauugguucagccgggaaaauucccugucugggguggagggagaaggccuucacaaacugggguacauccuccgcgacauuagcaagauccccggaggcaacauguaugcggaugacacagcugggugggauaccagaaucacagaggacgaucugcagaaugaggccaaaauuaccgacaucauggaaccugagcacgcccuucuggcuacguccauuuuuaagcucacauaccaaaacaaagucgugcggguccagcgccccgccaagucuggcaccgugauggauguuaucagcagacgggaccagagaggauccggccagguggggacauauggacugaacaccuucacgaauauggaaguccaacugauucgccagauggagucugaaggcaucuuuagcccguccgagcucgagaacagcaaucuggcugaacgggugcuugacuggcuggagaaacaugggguggaaagacucaagcgcauggccaucucuggagaugacuguguugugaagccuaccgaugaccgguucgcgacagcccugaccgcucuuaacgauaugggcaaagucagaaaggacauuccccagugggagccuuccaaaggguggaaugauuggcagcaagugcccuuuugcagccaccauuuccaccagcugaucaugaaggacggccgcgaaauuguugugccuugucggaaccaggaugagcucgucggacgggcccgcgugucucagggcgcuggguggucccugcgggagacagccugccugggaaaaagcuacgcgcaaauguggcagcucauguauuuucacagacgcgaccugcggcuugccgcuaaugccaucuguuccgcuguccccgugaacuggguuccgaccucuagaacaaccuggagcauucaugcccaccaucaguggaugacgacagaagauaugcuguccguguggaaucgggucuggaucgaggaaaacccuuggauggaggacaagacccacgugagcucuugggaagacguucccuaccucggcaagagagaggaucaauggugcgggucccugauuggacuuaccgcucgcgccacaugggcgaccaauauccagguggccaucaaccagguccggagacugauuggcaaugagaacuaucucgacuacaugacaagcaugaaacgcuucaagaaugaaucugaucccgagggggcucugugguga

SEQ ID NO: 18488 - RNA, 9879 nt, Artificial Sequence
  derived and/or modified CDS sequence (opt5) from DENV-1__KX380802__SS-prME
agcgugaccaugcugcucaugcugcuucccacagcccuggcuuuccaccucacgacccggggaggggaaccucauaugaucguguccaagcaagaacggggaaaaucucugcuuuuuaagacaagcgccggaguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggggaaacucacccugaagggcguguccuaugucauguguacgggauccuucaaacuggagaaggaaguggccgagacacagcacggcaccguucuugugcaggucaaguacgaggggaccgacgcgccgugcaaaauuccuaucucuacacaagaugaaaagggagugacccagaacggccggcucaucacagcuaaucccauugugacggacaaagagaagccuguuaacaucgaaaccgagccgcccuucggggaguccuauauugucaucggagccggcgaaaaagcccugaagcugagcugguuuaagaaagggucuagcauuggcaagauguucgaggcuacagccagaggagcucgccggauggccauccucggcgauaccgcgugggacuuuggguccaucggaggcguguucacaucuguggggaaacugguccaucagguguuuggaaccgccuacggcguucuuuucagcgggguguccuggacgaugaagauuggcaucggcauucugcucaccuggcugggccugaauagcagaucuacaucccuuagcaugaccuguaucgcugucgggauggugacacucuaccugggaguuauggugcaggccgauucuggcugcgucauuaacuggaaagggcgcgaacugaaguguggauccggcaucuuugugaccaacgagguucacacauggaccgaacaauauaaguuccaggcugacagcccuaaacggcucuccgccgcgauugggaaggccugggaggagggcgugugcggaaucagaucugcuacgcgccuggaaaauaucauguggaaacagauuagcaacgagcuuaaucauauccugcucgaaaacgauaugaaguuuacagucguggugggcgacgccaaugggauucugacccagggcaagaaaaugauccggccgcaacccauggagcacaaauacuccuggaagucuuggggcaaggcuaaaauuaucggggccgacacccagaacacaaccuucaucauugauggaccugacacgcccgaauguccugaugaccagagagccuggaauaucugggaggucgaggauuauggcuuuggcguuuucacaaccaacauuuggcugaaacuucgcgacagcuacacacagaugugcgaucaccggcucauguccgcugcgaucaaagacagcaaggccgugcaugcugauaugggguauuggauugaaucugagaaaaaugaaaccuggaagcuggccagagccuccuuuaucgaggugaagacauguaucuggccccgcagccacacccuguggucuaacggaguccucgaauccgagaugauuaucccgaaaauuuacggcgggccuaucagccaacauaauuaucggcccggauacuucacgcagaccgcuggcccuuggcaccuggggaaacuugagcuggacuucaaccucugcgaaggaacaaccgugguuguggaugagcacugcggcaauagaggccccucucugcggacaaccacggucacagggaaaauuauccaugaaugguguugccgcagcuguacccugccuccccuuagauuucggggagaggacggcugcugguacgggauggagaucagaccggugaaggaaaaagaggaaaaccucguucgcuccauggugagcgccggaucuggcgaggucgauuccuucagccuggggcugcucuguguguccauuaugaucgaagagguuaugcggucuagauggagccgcaagaugcugaugacaggaacccuugcgguguuuuuccugcucauuaugggccagcugaccuggaaugaccugaucagacuuugcauuauggucggcgcuaacguguccgaccggauggggaugggaacaacguaucuggcccucauggccaccuuuaagaugcgcccuauguucgcugugggccugcucuuuagacggcugacaucucgcgagguccuucugcucaccaucgggcugagccugguugccuccguggaacuucccaacucucuggaggaacucggagauggccuggcgauggggauuaugaugcucaaacugcuuacagacuuccaaagccaccagcuguggaccacgcuccugucccugacauuuaucaagaccacccuuagccuggauuacgcuuggaaaacaauggccauggugcucucuaucgucucccuguucccccucugucugagcaccacaucucagaagacgaccuggcuuccugugcugcugggauccuuuggcugcaaaccgcucacaauguuccugauuaccgagaauaagaucuggggcagaaagagcuggccccuuaacgaagggauuauggccguuggaaucgugucuauucugcucuccagccugcucaaaaaugacgucccucuggcuggcccccuuaucgccgggggaaugcugaucgcuuguuaugugauuuccggcagcucugccgaucugagccucgagcgggcggccgagguuuccugggaagaggaagcugagcauucuggggccagccacaacauccugguggaaguccaggacgauggaacaaugaagauuaaagacgaggagcgcgaugacacccuuacgauccugcucaaggcuacccugcucgccguguccggcgucuacccuaugucuauucccgccacacuguuugugugguauuucuggcagaagaagaaacagagaagcggcguucuuugggauaccccuagcccucccgaaguggagcgggcuguccuggacgaugggaucuaccgcauccugcagagaggacuccugggccggucucagguggggguuggaguguuccaagacggcgucuuucauacaauguggcacgugaccagaggggcggugcuuauguaucagggaaagcgccuggaacccagcugggccuccguuaagaaagaccucauuagcuacggcggcggguggcgguuccagggaucuuggaauacaggcgaggagguccaggugaucgcuguggaacccgggaagaacccuaaaaauguccaaacgacccccggaacauuuaagaccccggagggcgaagugggggccauugcccuggauuucaaaccuggaaccuccggcagccccaucguuaacagagagggcaagauuguggggcucuacggaaauggcgucgugacaacgucugggaccuauguuuccgcuaucgcccaggcgaaggcuagccaggaaggaccucugcccgagauugaggacgaaguguuuaaaaagcgcaaccuuacaaucauggaucugcaccccggcuccgggaaaacccggagauaccugccugccaucguccgcgaggccauuaagcggaaacucagaacacugauccuugcuccgacccgcgugguugccucugaaauggcggaggcucugaagggcaugcccauucgguaucaaacgacagccgucaagagcgaacauaccggaaaagagaucgucgaccucaugugccacgccaccuucacaaugagacugcuguccccugugcgggugcccaauuacaacaugauuaucauggaugaggcucauuuuaccgacccugccagcaucgcugcccgcggcuauauuucuacaagagucgggaugggagaagcggccgcuaucuucaugaccgccacgcccccuggcuccguugaggcuuuuccgcagagcaaugccgugauucaggaugaagaacgggacauccccgaacgcucuuggaacagcggguacgauuggauuacagacuucccuggaaagaccgugugguuuguccccuccaucaaaucuggcaaugauaucgccaacugucucagaaagaacgggaaacgggugauucagcuuagcagaaagacauucgacaccgaguaucaaaagacgaaaaauaacgacugggauuacguugugaccacagacaucuccgagaugggcgcuaauuuccgcgcggaucgggucauugacccuagacgcugccugaagcccgugauccugaaagauggaccggaacggguuauucucgccggcccuaugcccgugaccgcugccucugccgcucagagacgcgggcggaucggaagaaaccagaauaaggagggcgaccaguacauuuauauggggcaaccccugaacaaugaugaagaccacgcccauuggacagaggcgaaaaugcuucuggauaacaucaauaccccugagggaaucauucccgcucucuuugaaccugagcgcgaaaagagcgccgccaucgacggcgaguacagacugagaggggaagcucgcaagacauucgucgagcugaugagacggggcgaucucccgguguggcuuuccuauaaagucgccagcgagggauuucaguacucugaccgcagauggugcuucgauggcgaacggaacaaucaggugcuggaggaaaacauggacguugagauuuggaccaaggaaggggagcgcaagaagcugcgcccccgguggcucgacgcgagaacguauuccgauccucuggcccuucgcgaguuuaaagaguucgcugccggacggagaagcguguccggcgaccugauccucgagauugggaagcugccccagcaccugacacuccgggcucaaaaugcccuugauaaccuggugaugcugcacaauucugaacagggaggcaaggcuuaccgccaugccauggaggaacucccugacaccaucgagacccugaugcuucuggcgcucaucgccguccugacaggcgggguuacccuguuuuuccucagcggaaagggccuugggaagacauccauuggacugcugugugugauggcuucuagcgugcuccuguggauggccuccgucgagccccacuggaucgcugccagcauuauccuugaauuuuuccugauggugcuccugauuccggagccugauagacagcggacgccccaggacaaccaacuggccuauguugugaucggccuccuuuuuaugauccugaccgucgcugcgaacgaaauggggcugcucgagacaaccaaaaaggaucugggaauuggccauguggucgccgagaaucaccaccaugcuacaaugcuugacaucgaucugcacccugccucugccuggacccucuacgcuguggccacgaccauuaucacacccaugaugcgccauaccauugaaaacacaaccgcgaauaucucccugacggccauugcuaaccaggccgcuauccugaugggccucgacaaaggguggccuaucagcaagauggauauuggaguuccccuucuggcccugggcugcuacucucaggugaauccgcucacacugaccgcggccguccuuaugcugguggcucacuaugccaucauugggccuggacuccaagcuaaagccacaagagaggcucagaagcggaccgccgcgggcaucaugaagaaccccaccguugacgggauuguggccaucgaucuggaccccgucguguacgacgcuaaauucgaaaagcagcugggacagaucaugcuccuuauucuguguacaucccaaauccugcucaugcgcacgaccugggcccugugcgagagcauuacacuugcuaccggcccucugacaacccucugggaaggcucuccggggaaauuuuggaauacgacaaucgccgugagcauggccaacauuuucagaggauccuaucuggcgggcgcugggcuggccuucucucucaugaaaagccuuggaggcgggcggcgcggaaccggcgcucagggcgagacccugggggagaaauggaagagacagcugaaucagcucuccaagagcgaauuuaacacauacaaacgguccggaaucauggagguugauagaucugaagccaaggagggccugaaacgcggggaaaccacaaagcaugccgucagccggggaacggcuaaacuuagaugguucguggagcgcaaucuggugaagcccgagggcaaggucaucgaccucggguguggacggggcggcugguccuauuacugcgccgggcugaaaaagguuaccgaagugaaaggauauacaaagggcgggccuggacacgaggaacccauuccuauggcgaccuacggcuggaacaucgugaaacugcacucugggagagaugucuuuuucacacccccugagaagugugacacccuccuuugcgauauuggagaaagcuccccgaaucccacgaucgaggagggccgcacccugcgggugcugaaaaugguugaaccuuggcucagaggcaaccaauuuuguauuaagauccugaaucccuacaugccuucuguggucgagacacuugaacagaugcagcgcaagcaugggggaaugcuggugcggaacccccucagcagaaauuccacccacgagauguauuggguuagcugcggcacagggaacauugugucugccgucaacaugaccucccgcaugcugcugaaucgguucacaauggcucauagaaaaccgaccuacgagcgcgacguggaucucggagccggcacgagacacguggcugucgaaccugagaucgccaaccuggacaucauugggcagcggaucgaaaauauuaagaacgagcacaaaagcacauggcauuaugaugaagacaaucccuacaagaccugggcguaucacggaucuuacgagguuaaacccuccggcagcgccucuuccauggugaacggcgugguccgccuucugaccaagccuugggaugugauccccaugguuacacaaauugcuaugacggacaccacaccuuuugggcagcagagaguguucaaggagaaagucgacacccggacaccgagacccaagcggggaaccgcccaaaucauggaagugacagcuaaauggcucuggggcuuucugagccgcaauaagaaaccuagaaucuguacccgggaggaguucacgcgcaagguuagauccaacgccgcuauuggggccguguuugucgaugagaaucaguggaacagcgcgaaggaagccguggaggacgagcgguucugggaucuuguucaucgcgaaagagagcugcacaaacagggaaagugcgcuaccugcguguauaauaugaugggcaaacgggaaaagaaacucggggaguuuggcaaggccaagggaucucgcgcuaucugguacauguggcugggcgccagauuccuggaguucgaggcccucggguuuaugaacgaggaccauugguucagccgggaaaauucccugucuggagucgagggcgaagggcuucacaaacugggauacauucuccgcgauaucagcaagauucccggcgggaacauguaugcggacgauacagcuggcugggacaccagaaucacagaggaugaccugcagaaugaggccaaaaucaccgauauuauggaaccugagcacgcccuucuggcuacguccaucuuuaagcucacauaccaaaacaaagugguccgggugcagcgccccgccaagucuggaaccguuauggacgugauuagcagacgggaucagagaggcuccgggcaggucggaacauauggccugaacaccuucacgaauauggaagugcaacugauccgccagauggagucugaagggauuuuuagcccguccgagcucgagaacagcaaucuggcugaacgggugcuugacuggcuggagaaacauggaguugaaagacucaagcgcauggccaucucuggcgacgauuguguggucaagccuaccgacgaucgguucgcgacagcccugaccgcucuuaacgacauggggaaagugagaaaggauaucccccagugggagccuuccaaaggcuggaaugacuggcagcaaguucccuuuugcagccaccauuuccaccagcugauuaugaaggauggacgcgaaaucguggucccuugucggaaccaggacgagcucgugggcagagcccgcgucucucagggggcuggauggucccugcgggagacagccugccugggcaaaagcuacgcgcaaauguggcagcucauguauuuucacagacgcgaucugcggcuugccgcuaaugccauuuguuccgcugugcccguuaacugggugccgaccucuagaacaaccuggagcauccaugcccaccaucaguggaugacgacagaagacaugcuguccgucuggaaucggguguggauugaggaaaacccuuggauggaggauaagacccacguuagcucuugggaagacgugcccuaccucgggaagagagaggaccaauggugcggaucccugaucggccuuaccgcucgcgccacaugggcgaccaauauucaggucgccaucaaccaggugcggagacugaucgggaaugagaacuaucucgauuacaugacaagcaugaaacgcuucaagaaugaaucugaccccgagggcgcucugugguga

SEQ ID NO: 18489 - RNA, 9879 nt, Artificial Sequence
  derived and/or modified CDS sequence (opt5) from DENV-1__KX380797__SS-prME
agcgugaccgugcugcucaugcugcuucccacagcccuggcuuuccaccucacgacccggggcggggaaccucauaugaucguuuccaagcaggaacggggaaaaucucugcuuuuuaagaccagcaccggcgugaacaugugcacccugauugccauggaccucggggaacugugugaagauaccaugacauacaaaugcccgcgcaucaccgagacggaacccgacgauguggacuguuggugcaaugcgaccgagacaugggucaccuauggaacauguucccaaaccggcgagcacagacgggauaagcgcucuguggcucuggccccucauguugggcucggacuggaaacgagaacagagaccuggaugagcuccgaaggcgccuggcggcagauucagaaaguggagacaugggcucuuagacaccccggcuucaccgucaucgcccuguuucucgcucaugccauugggaccucuaucacacagaagggaaucauuuucauccugcuuaugcuggugacgccuagcauggcgaugagaugcguuggcauugggaaccgggacuuuguggagggacucuccggcgccaccugggucgauguggugcuggaacacgggagcugugucacaaccauggcuaaggacaaacccacacuggauaucgagcuccugaagaccgaaguuacgaauccugccgugcuucgcaaacugugcauugaggcuaagaucucuaacacaaccaccgacuccagauguccgacacaaggagaagccacccucguggaggagcaggauacaaauuucgucugccggcgcacgcugguggacagaggcuggggcaacggguguggacuuuuuggcaaagggagccugauuaccugcgcgaaguucaagugcguuacaaaacucgaaggaaagaucgugcaguacgagaaucugaaauauucugucaucgugaccguucacacaggcgaucagcaucaaguggggaacgaaaccacggagcacggaaccacagccaccauuacaccccaggcuccuaccuccgaaauccagcugacggacuacggcgcccucacacuggacuguagcccccggaccggccuugauuuuaaugagaugguccugcucacaaugaaggagaaaucuuggcuggugcauaagcagugguuccuugaccugccucuccccuggaccuccggggcuagcaccucccaagaaacauggaaccgccaggaucugcuggucacguuuaaaaccgcccacgccaagaagcaggaggugguugugcucggaucucaagaaggcgcuaugcacacagcgcugaccggggccacagagauucagaccagcggaacgacaaccaucuucgcuggccaucuuaaaugcagacugaagauggacaaacucacccugaagggggucuccuaugugauguguacaggcagcuuuaaacuggaaaaggagguugccgagacccagcacggaacagugcuuguccaggugaaguacgaaggcacggaugccccgugcaaaauuccuuucaccucucaagacgagaagggggugacacagaauggacggcucaucaccgcuaaccccaucguuacagauaaagaaaagccugucaauauugaggccgagccgcccuucggcgaauccuaucugguggugggggcgggagagaaagcucugaagcucagcugguuuaagaaaggcucuagcaucgggaagauguucgaagccaccgccagaggcgcucgccggauggccauucugggagacacggcuugggauuuuggcuccaucgggggagucuucaccucugugggcaaacuuauucaucagaucuuugggacagccuacggaguucuguucagcggcguguccuggaccaugaagaucgggauuggcauccuccugacauggcugggacuuaacagcagaucuaccucccucagcaugacauguauugcggucggcauggugacccuguaccuggggguuauggugcaggccgacucuggaugcgucaucaauuggaaaggccgcgagcucaaguguggguccggaauuuuugugacgaacgaaguucacacauggaccgagcaauauaaguuccaggcugauagcccuaaacggcuguccgccgcuaucggcaaggccugggaggaaggggugugcggcauuagaucugcgacccgccuugagaacaucauguggaaacagaucagcaaugaacugaaccauauucuccuggagaaugacaugaaguuuacagucguggugggagacgucaacggcauccuggcccaggggaaaaagaugauucggccgcaacccauggaacacaaauacuccuggaagucuuggggaaaggcuaaaguuaucggcgccgaugugcagaauagcaccuucauuaucgacgggccuaacacgcccgaguguccugaugaccagagagcuuggaauaucugggagguggaagauuauggauuuggcauuuucacaaccaacaucuggcuuaagcuccgcgacuccuacacacaggucugcgaucaccggcugaugagcgccgccauuaaagacucuaaggcugugcaugcggauaugggcuauuggaucgaguccgagaagaaugagaccuggaagcugacaagagccagcuuuauugaaguuaagaccuguguguggcccaaaucucacacgcucugguccaacgggguccuggagagcgagaugaucaucccgaagauuuacggaggcccuaucucucaacauaauuaucgccccggguacuucacccagacagcuggaccuuggcaccuuggcaaacuggaacucgacuucgggcugugcgagggaaccacagugguuguggaugaacacugcggcaaccggggccccagccugagaaccacgacagucaccgggaagauuauccaugagugguguugccgguccuguacacuuccuccccuccgcuuuaaaggagaggacggcugcugguacgggauggaaauuagaccggugaaggagaaggaagagaaucugguuaaaagcauggugucugccggauccggcgaagucgauagcuucucccuggggcuccuguguaucucuaucaugauugaggaggugaugcggagcagauggucccgcaagaugcuuaugaccggaacccuggccguguuucuccugcugaucaugggccagcuuacauggaacgaccugauucggcucugcaucauggucggcgcuaaugccucugacaaaauggggaugggaacgaccuaucuggcgcucauggcuacauucagaaugcgcccuauguuugccguuggccugcuuuucagacggcugaccagccgcgaagugcuccugagauccguggggcugucucuugucgccagcguggagcugcccaacucccucgaagaacugggagauggccucgcuauggggauuaugaugcugaaacuucugacagacuuucaaagccaccagcucugggccgcgcugcugucucuuaccuucguuaaaacgacauuuucccugcauuacgcuuggaagaccauggccaugauccucagcauugugucucuguucccccucugucuguccaccacaagccagaagaccacauggcuuccuguccugcugggaucucucggcugcaaaccgcugacgauguuucuuaucaccgaaaacaagaucuggggccggaaauccuggccccugaaugaggggauuauggccgugggaaucguuagcauucuccuguccagccuccugaagaacgaugugccucuugcuggcccccugaucgccgggggaaugcugauugcuuguuaugucaucucuggcagcuccgccgaccucucucuggagaaagcggccgaagugagcugggaggaagaggcugaacacuccggggccucucauaauauccuugucgaggugcaggaugacggaacaaugaagauuaaagaugaggaacgcgacgauacccugacaauccuccugaaggcuacccuccuggccauuagcggcguuuacccuauguccauccccgccacgcuuuucgugugguauuuuuggcaaaagaaaaagcagagaucuggcguccugugggacaccccuagcccucccgagguggaacgggcuguucuggaugacgggauuuaccgcauccuccagagaggacugcuuggcaaaucccaggugggggucggaguguuccaagagggcguguuccacacaauguggcacguuaccagaggggcgguccugauguaucagggaaagcgccucgagcccagcugggccucugugaaaaaggaucugaucuccuacggcggcggguggagauuucagggaagcuggaacacaggcgaagaggugcaggucauugcuguggaacccgggaagaauccuaaaaacguucaaaccgcccccggaacauucaagacgccggagggcgaagugggggccaucgcucucgacuuuaaaccuggaaccucuggcucccccauugucaaucgggagggcaagaucguggggcuguacggaaacggcguugugacaaccagcgggaccuaugucuccgccauugcgcaggcuaaagccucucaggagggaccucuucccgaaaucgaggacgaaguguucagaaagcgcaaucugacaauuauggaucugcaucccggcagcgggaagacgcggagauaccucccugccaucguucgcgaggcuaucaaacggaagcugagaacccuugugcuggccccgacacgcgucguggcguccgaaauggcugaggcccucaaaggcaugcccauucgguaucaaaccacagccgucaagagcgagcacaccggaaaagaaaucgucgaccugaugugccaugcuacguuuacaaugagacugcucucuccuguucgcgugcccaacuacaauaugauuaucauggaugaggcccacuucaccgacccugcuuccauugccgcgcggggcuauaucagcaccagaguggggaugggagaagccgcugccaucuuuaugacagcuacacccccuggcucuauggaggccuucccgcagagcaacgccgcuauucaggaugaagaacgggacauccccgagcgcuccuggaacucuggguacgauuggauuacagacuuuccuggaaagaccgucugguucgugcccagcaucaaguccggcaacgauauugcgaauugucuucgcaaaaaugggaagcggguugugcagcugucucgcaaaacguuugacacagaauaucaaaagaccaaaaacaaugauugggacuacgucgugacaaccgacaucagcgagaugggcgccaacuucagagcugaucggguuaucgacccuagacgcugccugaagcccgugauucucaaggauggaccggaacgggucauccuggccggcccuaugcccgugacggucgccuccgcugcccagagacgcgggcggauuggaagaaaucagaacaaagagggcgaccaguacaucuauauggggcaaccccuuaauaacgaugaggaccaugcgcacuggaccgaagcuaagaugcugcucgauaauauuaacacaccugagggaaucauucccgcccuguucgaaccugagcgcgagaaaagcgccgcuaucgacggcgaguaccggcugagaggggaggcccgcaagaccuuuguggaacucaugagacggggcgaucuuccgguuuggcugucuuauaaaguggcguccgagggauuccaguacagcgaccgcagauggugcuuugauggcgaacggaauaaccaggugcuggaggaaaauauggacgucgagaucuggacaaaggagggggaacgcaaaaagcucagaccccgguggcuggaugccagaaccuauuccgacccucuugcucugcgcgaguucaaggaauuugccgcuggacggagaucuguuagcggcgaccucauucuggagaucgggaaacugccccagcaccucacacaacgcgcccagaacgcucuugauaaucuggugaugcugcauaacuccgaacagggaggcaaggccuaccggcacgcgauggaggagcucccugacaccauugaaacgcugaugcuucuggcccucaucgcugugcugacaggcggggucacccuguucuuucucucuggaagaggccuugggaaaaccagcauuggacugcugugugugauggccuccagcgcucuccuguggauggccucuguugagccccauuggaucgccgcuuccaucauucuugaguucuuucugauggugcuccugaucccggagccugaucggcagcgcacaccccaagacaaucagcuggcguaugucgugauuggccuccuuuucaugauccugaccgucgccgcuaacgagauggggcugcucgaaacaacgaagaaagaucugggaauuggccacguggccgccgagagccaccaucacgcugccaugcuugacguugaucugcauccugcgucugccuggacccucuacgcuguggccacaaccaucaucacacccaugaugagacacaccauugaaaacacgaccgcuaauaucucccugacagccauugcgaaccaggccgcuauccugaugggccucgacaagggguggccuauuagcaagauggauaucggagucccccuucuggcccugggcugcuacucucaagugaauccgcucacccugacagcugccguucuuaugcugguggcucauuaugccauuaucgggccuggacuccaggcgaaagccacccgggaggcucagaagcgcacggccgcuggcaucaugaaaaaccccacagucgacgggauuguggccaucgaucuggaccccgugguuuacgaugccaaguuugaaaaacagcugggacaaauuaugcuccuuauccuguguaccagccagauucugcucaugagaacaaccugggcgcugugcgaguccaucacccuugcuacaggcccucugacgacccucugggagggcucuccggggaaguucuggaauacaaccaucgccgucagcauggcuaacauuuuucggggauccuaucuggccggcgccgggcuggcuuucagccucaugaagucccuuggaggcgggcgcagaggaacaggcgcccagggcgaaacccugggggagaaauggaagcggcagcugaaucaacucacgaaaucugaguucaacacauacaagcgcagcggaaucauugagguggacagauccgaagcgaaagagggccugaagagaggggaaaccaccaagcacgccgugucucggggaacagcuaaacuucgcugguuugucgaacggaaucugguuaagcccgagggcaaagugaucgaccucggguguggaagaggcggcuggagcuauuacugcgccgggcugaagaaagugaccgaagucaagggauauacaaaaggcgggccuggacacgaggaacccauuccuauggcuacguacggcuggaaccuggugaagcucuacuccgggaaggauguuuucuuuacacccccugagaaaugugacacacuucugugcgauaucggagagucuagcccgaaucccaccaucgaagagggccgcacacugcgggugcucaagauggucgaaccuuggcugagaggcaaccaguucuguauuaaagugcuuaaucccuauaugccuuccguuguggagacccuggagcagaugcagcgcaagcaugggggaaugcucguccggaacccccugagcagaaauucuacgcacgaaauguacuggguguccugcggcaccgggaacaucgugagcgccgucaauaugacaucucgcaugcugcucaaccgguuuaccauggcgcauagaaaaccgacauaugagcgcgacguugaucugggagccggcacccggcacguggcuguggaaccugaggucgccaaccuugacauuaucgggcaaagaauugaaaauaucaagaacgagcacaaguccacauggcauuacgaugaggacaaucccuauaaaaccugggcuuaccacggaagcuaugaagugaagcccucuggcuccgccagcuccaugguuaacggcgugguccgccugcucacgaaaccuugggaugugauucccaugguuacacagaucgcuaugaccgacaccacaccuuucgggcagcaaagaguguuuaaggagaaagucgauacgcggaccccgaaggccaagcgcggaacagcgcagaucauggaagugaccgccagauggcuguggggcuuccuuagccggaauaaaaagcccagaauuuguacacgggaggaauuuacccgcaaaguuagaucuaacgcugccaucggggcuguguucgucgacgagaaucaguggaacagcgccaaggaggccguggaagacgagcgguuuugggaucugguccaucgcgaaagagagcuccacaaacagggaaagugcgcgacaugcguguacaauaugaugggcaagcgggagaaaaagcugggggaguucggcaaagcuaagggaucccgcgccauuugguacauguggcugggcgccagauuucucgaguucgaagcucugggguucaugaacgaggaccauugguuuucucgggaaaauagccuuuccggaguugagggcgaggggcugcacaaacucggauauauccugcgcgauauuucuaagaucccuggcgggaacauguacgccgacgauaccgcuggcugggacacgagaaucaccgaagaugaccuucaaaaugaggccaaaauuacagauaucauggaacccgagcacgcgcugcucgccaccagcauuuucaagcugacauaucagaacaaggugguccgggugcagcgcccugcuaaaaauggaaccgugauggacguuaucuccagacgggaucagcgcggcucugggcaagugggaacguacggccugaacacauuuaccaacauggaagcccagcucauuagacagauggagagcgaggggaucuuccugcccuccgaacuugagacaccgaaucuggcugaacggguccucgacuggcuggagaaguauggaaucgaaagacuuaaacgcauggccauuagcggcgaugacugugugguuaagccuguggacgaucgguuugcgaccgcccugacggcucucaacgacauggggaaagucagaaaggauaucccccagugggagccuucuaagggcuggaaugacuggcaacaggugcccuucugcucccaucacuuucaucagcugauuaugaaagauggacgcgagaucgucgugccuugucggaaccaggacgaacugguuggcagagcccgcgugagccaaggggcuggauggucucuccgggagaccgccugccugggcaaguccuacgcucagauguggcagcuuauguauuuccacagacgcgaucugcggcucgccgcgaaugccauuuguagcgcuguccccguggacuggguuccgacauccagaaccacauggucuauccacgcccaucaccaauggaugaccacagaagauaugcugagcguguggaaccgcgucuggaucgaggaaaauccuuggauggaggacaaaacccauguguccagcugggaggaugugcccuaccuugggaagcgggaagaccaguggugcggaucucugauuggccucacggccagagcuacaugggccaccaacauccagguugcgauuaaucagguccggagacugaucgggaacgagaauuaccuggacuauaugaccuccaugaaacgcuuuaagaacgaaagcgaucccgagggcgcucucugguga

SEQ ID NO: 18490 - RNA, 9879 nt, Artificial Sequence
  derived and/or modified CDS sequence (opt5) from DENV-1__KX380805__SS-prME
agcgugaccaugcugcucaugcugcuucccacagcccuggcuuuccaccucacgacccggggcggggagccucauaugauugucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggguguccuaugucauguguacgggcagcuucaaacuggagaaggaaguggccgagacacagcacggaaccguucuugugcaggucaaguacgagggcaccgaugcgccgugcaaaauuccuaucucuacacaagacgaaaagggggugacccagaacggacggcucaucacagcuaaucccauugugacggauaaagagaagccuguuaacaucgaaaccgagccgcccuucggcgaguccuauauugucaucggggccggagaaaaagcccugaagcugagcugguuuaagaaaggcucuagcauugggaagauguucgaggcuacagccagaggcgcucgccggauggccauccucggagacaccgcgugggauuuuggcuccaucgggggaguguucacaucugugggcaaacugguccaucagguguuugggaccgccuacggaguucuuuucagcggcguguccuggacgaugaagauugggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcucuccgccgcgauuggcaaggccugggaggagggggugugcggcaucagaucugcuacgcgccuggaaaauaucauguggaaacagauuagcaacgagcuuaaucauauccugcucgaaaacgacaugaaguuuacagucguggugggagacgccaauggcauucugacccaggggaaaaagaugauccggccgcaacccauggagcacaaauacuccuggaagucuuggggaaaggcuaaaauuaucggcgccgauacccagaacacaaccuucaucauugacgggccugauacgcccgaauguccugacgaucagagagccuggaauaucugggaggucgaggacuauggauuuggcguuuucacaaccaacauuuggcugaaacuucgcgauagcuacacacagaugugcgaccaccggcucauguccgcugcgaucaaagauagcaaggccgugcaugcugacaugggcuauuggauugaaucugagaaaaaugaaaccuggaagcuggccagagccuccuuuaucgaggugaagacauguaucuggccccgcagccacacccuguggucuaacgggguccucgaauccgagaugauuaucccgaaaauuuacggaggcccuaucagccaacauaauuaucggcccggguacuucacgcagaccgcuggaccuuggcaccugggcaaacuugagcuggauuucaaccucugcgaagggacaaccgugguuguggacgagcacugcggaaauagaggccccucucugcggacaaccacggucacaggcaaaauuauccaugaaugguguugccgcagcuguacccugccuccccuuagauuuagaggggaagauggaugcugguacggcauggagaucagaccggugaaggaaaaagaggaaaaccucguucgcuccauggugagcgccgggucuggagaggucgacuccuucagccugggccugcucuccgugucuauuaugaucgaagagguuaugcggagcagauggucccgcaagaugcugaugacagggacccuugcgguguuuuuccugcucauuaugggacagcugaccuggaaugaccugaucagacuuuguauuauggucggcgcuaacgugucugaucggaugggcauggggacaacguaucuggcccucauggccaccuuuaagaugcgcccuauguucgcugugggacugcucuuuagacggcugacaagccgcgagguccuucugcucaccaucggccugucccugguugccucuguggaacuucccaacagccuggaggaacucggggacggacuggcgaugggcauuaugaugcucaaacugcuuacagauuuccaaucccaccagcuguggaccacgcuccugagccugacauuuaucaagaccacccuuucucuggacuacgcuuggaaaacaauggccauggugcucuccaucgucagccuguucccccucugccugucuaccacaucccagaagacgaccuggcuuccugugcugcuggggagcuuuggauguaaaccgcucacaauguuccugauuaccgagaauaagaucuggggcagaaagucuuggccccuuaacgaaggcauuauggccguugggaucguguccauucugcucagcucccugcucaaaaaugaugucccucuggcuggaccccuuaucgccggcgggaugcugaucgcuugcuaugugauuagcggaucuagcgccgaccugucccucgagcgggcggccgagguuucuugggaagaggaagcugagcauagcggcgccucccacaacauccugguggaaguccaggaugacgggacaaugaagauuaaagaugaggagcgcgacgauacccuuacgauccugcucaaggcuacccugcucgccgugucuggagucuacccuaugagcauucccgccacacuguuugugugguauuucuggcagaagaagaaacagagauccggcguucuuugggacaccccuucucccccggaaguggagcgggcuguccuggaugacggcaucuaccgcauccugcagagagggcuccugggacggagccaggugggcguugggguguuccaagacggagucuuucauacaauguggcacgugaccagaggcgcggugcuuauguaucaggggaaacgccuggaaccuuccugggccagcguuaagaaagaucucauuucuuacggaggcggcuggcgguuccagggguccuggaauacaggagaggagguccaggugaucgcuguggaacccggcaagaacccuaaaaauguccaaacgacccccgggacauuuaagaccccggagggagaagugggcgccauugcccuggacuucaaaccugggaccagcggaucucccaucguuaacagagagggcaagauugugggccucuacgggaauggagucgugacaacguccggcaccuauguuagcgcuaucgcccaggcgaaggcuucccaggaagggccucugcccgagauugaggaugaaguguuuaaaaagcgcaaccuuacaaucauggaccugcaccccggaucuggcaaaacccggagauaccugccugccaucguccgcgaggccauuaagcggaaacucagaacacugauccuugcuccgacccgcgugguugccagcgaaauggcggaggcucugaaggggaugcccauucgguaucaaacgacagccgugaaguccgaacauaccggcaaagagaucgucgaucucaugugucacgccaccuucacaaugagacugcugagcccugugcgggugcccaauuacaacaugauuaucauggacgaggcucauuuuaccgauccugccucuaucgcugcccgcggauauauuuccacaagagucggcaugggggaagcggccgcuaucuucaugaccgccacgcccccuggaagcguugaggcuuuuccgcagucuaaugccgugauucaggacgaagaacgggauauccccgaacgcagcuggaacuccggcuacgacuggauuacagauuucccugggaagaccgugugguuuguccccucuaucaaaagcggaaaugacaucgccaacugccucagaaagaacggcaaacgggugauucagcuuuccagaaagacauucgacaccgaguaucaaaagacgaaaaauaacgauugggacuacguugugaccacagauaucucugagaugggggcuaauuuccgcgcggaccgggucauugauccuagacgcugucugaagcccgugauccugaaagacggcccggaacggguuauucucgccggaccuaugcccgugaccgcugccagcgccgcucagagacgcggccggaucgggagaaaccagaauaaggagggagaucaguacauuuauaugggccaaccccugaacaaugacgaagaucacgcccauuggacagaggcgaaaaugcuucuggacaacaucaauaccccugaggggaucauucccgcucucuuugaaccugagcgcgaaaaguccgccgccaucgauggagaguacagacugcggggcgaagcucgcaagacauucgucgagcugaugagaagaggggaccucccgguguggcuuagcuauaaagucgccucugagggcuuucaguacuccgaucgcagauggugcuucgacggagaacggaacaaucaggugcuggaggaaaacauggacguugagauuuggaccaaggaaggcgagcgcaagaagcugcgcccccgguggcucgaugcgagaacguauagcgacccucuggcccuucgcgaguuuaaagaguucgcugccgggcggagauccgugucuggagaucugauccucgagauuggcaagcugccccagcaccugacacuccgggcucaaaaugcccuugacaaccuggugaugcugcacaauagcgaacaagggggaaaggcuuaccgccaugccauggaggaacucccugauaccaucgagacccugaugcuucuggcgcucaucgccguccugacaggcggcguuacccuguuuuuccucuccgggaagggacuuggcaagacaucuauugggcugcugugcgugauggcuagcuccgugcuccuguggauggccagcgucgagccccacuggaucgcugccucuauuauccuugaauuuuuccugauggugcuccugauuccggagccugacagacagcggacgccccaggauaaccaacuggccuauguugugaucggacuccuuuuuaugauccugaccgucgcugcgaacgaaaugggccugcucgagacaaccaaaaaggaccuggggauuggacauguggucgccgagaaucaccaccaugcuacaaugcuugauaucgaccugcacccugccuccgccuggacccucuacgcuguggccacgaccauuaucacacccaugaugcgccauaccauugaaaacacaaccgcgaauaucagccugacggccauugcuaaccaggccgcuauccugaugggccucgauaaaggcuggccuaucucuaagauggacauugggguuccccuucuggcccugggauguuacucccaggugaauccgcucacacugaccgcggccguccuuaugcugguggcucacuaugccaucauuggcccugggcuccaagcuaaagccacaagagaggcucagaagcggaccgccgcgggaaucaugaagaaccccaccguugauggcauuguggccaucgaccuggaccccgucguguacgaugcuaaauucgaaaagcagcuggggcagaucaugcuccuuauucugugcacaagccaaauccugcucaugcgcacgaccugggcccugugugagucuauuacacuugcuaccggaccucugacaacccucugggaaggcagcccgggcaaauuuuggaauacgacaaucgccguguccauggccaacauuuucagagggucuuaucuggcgggagcuggccuggccuucagccucaugaagucccuugggggaggccggcgcgggaccggagcucagggcgagacccugggcgagaaauggaagagacagcugaaucagcucagcaaguccgaauuuaacacauacaaacggucugggaucauggagguugacagaagcgaagccaaggagggacugaaacgcggcgaaaccacaaagcaugccgucucccgggggacggcuaaacuuagaugguucguggagcgcaaucuggugaagcccgagggaaaggucaucgaucucggcugcgggcggggaggcuggucuuauuacugugccggccugaaaaagguuaccgaagugaaaggguauacaaagggaggcccugggcacgaggaacccauuccuauggcgaccuacggauggaacaucgugaaacugcacagcggcagagacgucuuuuucacacccccugagaagugcgauacccuccuuugugacauuggggaauccucuccgaaucccacgaucgaggagggacgcacccugcgggugcugaaaaugguugaaccuuggcucagaggcaaccaauuuugcauuaagauccugaaucccuacaugccuagcguggucgagacacuugaacagaugcagcgcaagcauggcgggaugcuggugcggaacccccucuccagaaauagcacccacgagauguauuggguuucuuguggaacaggcaacauuguguccgccgucaacaugaccagccgcaugcugcugaaucgguucacaauggcucauagaaaaccgaccuacgagcgcgauguggaccucggggccggaacgagacacguggcugucgaaccugagaucgccaaccuggauaucauuggccagcggaucgaaaauauuaagaacgagcacaaaucuacauggcauuaugacgaagauaaucccuacaagaccugggcguaucacggguccuacgagguuaaacccagcggaucugccuccagcauggugaacggcgugguccgccuucugaccaagccuugggacgugauccccaugguuacacaaauugcuaugacggacaccacaccuuuuggccagcagagaguguucaaggagaaagucgauacccggacaccgagacccaagcgggggaccgcccaaaucauggaagugacagcuaaauggcucuggggauuucugucccgcaauaagaaaccuagaaucugcacccgggaggaguucacgcgcaagguuagaagcaacgccgcuauuggcgccguguuugucgacgagaaucaguggaacucugcgaaggaagccguggaggaugagcgguucugggaccuuguucaucgcgaaagagagcugcacaaacaggggaagugugcuaccugcguguauaauaugaugggaaaacgggaaaagaaacucggcgaguuugggaaggccaagggcagccgcgcuaucugguacauguggcugggagccagauuccuggaguucgaggcccucggcuuuaugaacgaggaucauugguucucccgggaaaauucucugagcggggucgagggagaaggccuucacaaacugggguacauucuccgcgacaucuccaagauucccggaggcaacauguaugcggaugacacagcugggugggauaccagaaucacagaggacgaucugcagaaugaggccaaaaucaccgacauuauggaaccugagcacgcccuucuggcuacgucuaucuuuaagcucacauaccaaaacaaagugguccgggugcagcgccccgccaagagcggcaccguuauggaugugauuuccagacgggaccagagaggaucuggccaggucgggacauauggacugaacaccuucacgaauauggaagugcaacugauccgccagauggagagcgaaggcaucuuuuccccgagcgagcucgagaacucuaaucuggcugaacgggugcuugacuggcuggagaaacaugggguugaaagacucaagcgcauggccaucuccggagaugacugcguggucaagccuaccgaugaccgguucgcgacagcccugaccgcucuuaacgauaugggcaaagugagaaaggacaucccccagugggagccuagcaaaggguggaaugauuggcagcaaguucccuuuuguucucaccauuuccaccagcugauuaugaaggacggccgcgaaaucguggucccuugccggaaccaggaugagcucgugggacgggcccgcgucucccagggcgcuggguggagccugcgggagacagccugucugggaaaauccuacgcgcaaauguggcagcucauguauuuucacagacgcgaccugcggcuugccgcuaaugccauuugcucugcugugcccguuaacugggugccgaccagcagaacaaccugguccauccaugcccaccaucaguggaugacgacagaagauaugcugagcgucuggaaucggguguggauugaggaaaacccuuggauggaggacaagacccacguuucuuccugggaagacgugcccuaccucggcaagagagaggaucaauggugugggagccugaucggacuuaccgcucgcgccacaugggcgaccaauauucaggucgccaucaaccaggugcggagacugaucggcaaugagaacuaucucgacuacaugacaucuaugaaacgcuucaagaaugaaagcgaucccgagggggcucugugguga

SEQ ID NO: 18491 - RNA, 9879 nt, Artificial Sequence
  derived and/or modified CDS sequence (opt5) from DENV-1__KX380798__SS-prME
agcgugaccaugcugcucaugcugaugcccaccgcccuugcuuuccaccugacgaccagaggcggggagccucauaugaucguguccaagcaggaacggggaaaaucucuccuguuuaagaccagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaaguucacagugguugugggagaugucgcuggcauccucgcccaggggaaaaagaugauucggccgcaacccauggaguacaaauauucuuggaaaagcuggggaaaggccaagaucaucggcgcugacgugcagaauaccaccuuuauuaucgaugggccuaacacacccgaauguccugacgaucagagagcguggaauauuugggagguggaggacuacggauucggcaucuuuaccacgaacauuuggcugaagcugcgcgauuccuauacacaggucugcgaccaccggcuuaugagcgccgcuaucaaagauucuaaggccguucacgccgacaugggcuacuggaucgaauccgagaaaaaugaaaccuggaagcucgcuagagccagcuucauugaggugaagacauguaucuggcccaaaucucauacccugugguccaacggggugcuggaaagcgagaugauuaucccgaagauuuauggaggcccuaucucucaacacaauuaccgccccggguacuucacacagaccgcgggaccuuggcaucucggcaaacuggagcuugauuuugaccugugcgaagggacgaccgucgugguugaugagcacugcggaaaccggggccccagccucagaacaaccacagugaccggcaagaucauucacgaaugguguugccgguccuguacgcugccuccccugcgcuucagaggggaggacggaugcugguauggcauggagauccggccggucaaagaaaaggaggaaaaucuugucaagagcaugguuucugcuggguccggagagguggacagcuuuucccucggccugcuguguauuucuaucaugauugaagaggucaugagaagccgcuggucccggaaaaugcucaugacagggacccuggccguguuccuucugcucaucaugggacagcugacauggaacgaucugauuagacuuugcaucaugguuggcgccaaugcuucugaccgcaugggcauggggaccaccuaccuggcccucauggcgacauuuaagaugagaccuauguucgcugugggacugcucuuucggcgccugacgagcagagagguccuucugcucaccaucggccugucccugguggccucuguggaacuucccaacagccuggaggaacucggggauggacuggccaugggcauuaugauccucaaacugcuuacagacuuccaaucccaucagcugugggcuacccuccugagccugacauuuauuaagaccacguucucucuucacuaugccuggaaaacaauggcuaugguccuguccaucguuagccucuuuccccugugucucucuaccaccucccagaagacaaccuggcugccugugcuucuggggagccugggaugcaagccgcucacaauguuccugauugccgagaauaaaaucuggggccggcgcucuuggccccuuaacgaaggcaucauggcgguggggauugucuccauccugcucagcucccugcucaagaacgaugugccucuggccggaccccuuauugcuggcgggaugcugaucgccuguuacguuauuagcggaucuagcgcugaccugucccucgagaaagccgccgaggugucuugggaagaggaagcugagcauagcggcgcgucccacaauauccuggucgaagugcaggaugacgggacgaugaagaucaaagaugaggagagagacgauacccuuacaauucugcucaaggccacccugcucgcuguuucuggaguguauccucugagcauccccgccacacuuuuugucugguacuucuggcagaagaagaagcagcgguccggcgugcugugggacaccccuucucccccggaagucgagcgcgccgugcuggaugacggcauuuauagaaucaugcagcgggggcuccugggacgcagccagguuggcgugggggucuuccaagaaaacguguuucauacgauguggcacguuaccagaggagcugugcuuauguaccagggcaaacggcuggagccuuccugggccagcgucaagaaagaccucauuucuuacgggggaggcuggagacugcagggcuccuggaauacaggggaggaagugcaagugaucgcgguugagcccggaaagaacccuaaaaauguccaaaccgcucccggcacauucaagaccccggaaggggaggugggagccauugcccucgauuuuaagccuggcacaagcgggucucccaucgugaaccgcgaaggaaaaaucgucggccuguauggcaauggggugguuacgaccuccggaacauacgugagcgcuauugcccaggcgaaggcuucccaggagggcccucuucccgagaucgaagacgaggucuuccggaaaagaaaccugaccauuauggaucugcaccccgggucuggaaagacccgccgguaucucccugccaucgugagagaagccauuaaacgcaagcugcggacacuuauccuggcuccgacgagaguuguggccagcgagauggcugaagcccucaagggcaugcccauccgcuaccaaaccacagcggucaaauccgagcauaccgggaaggagauuguggaccugaugugccacgccacauuuaccaugcggcugcucagcccuguuagagugcccaauuauaacaugaucauuauggaugaagcucauuucacggacccuucuuccaucgccgcucggggcuacauuagcacacgcgucggaaugggcgaggccgccgcuaucuuuaugaccgcgacacccccugggucuguggaagccuucccgcagagcaaugcugugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacauuugauaccgaauaccagaaaacgaagaacaacgacugggacuacguggucacaaccgauaucagcgagaugggcgccaauuucagagcugaccgcgugauugauccucggagaugccugaaacccguuauccucaaggacgggccggaacgcgugauccuggccggcccuaugcccgucacaguggcguccgcugcccagcggagaggacgcauuggccggaaccacaauaaagagggggaucaguauaucuacaugggacagccccuuaacaaugacgaggaucaugcccacuggaccgaagcuaagaugcugcucgacaacauuaauacgccugagggcaucauucccgcccuguucgaaccugagagagaaaagagcgcggccaucgauggggaguaucgccugagaggagaggcucggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcgcaaaaugcccuugacaaccugguuaugcugcauaauuccgaacagggcgggcgggcuuaucgccacgccauggaggagcucccugauaccauugaaacacugaugcuucuggcucucaucgccgugcugaccggaggcgugacgcuguucuuucucucuggcagagggcuuggaaagacaagcauuggccugcugugugucauggccuccagcguucuccuguggauggcuucuguggagccccauuggaucgcggccuccaucauucuugaguucuuucugauggugcuccugaucccggagccugaccggcagcgcacaccccaggauaaccaacuggcuuacgucgugauugggcuccuuuucaugauccugaccguugccgccaaugagaugggacugcucgaaacaaccaagaaagaccugggcauugggcacguggcugucggaaaccaccaucacgccgcgaugcuugauguggaccugcauccugccagcgcuuggacacucuacgccgucgcuacgaccaucauuacacccaugaugagacacaccaucgagaacacaaccgccaauaucucucugacggcgauugccaaccaggcugccauccugaugggccucgauaagggcuggccuauuuccaaaauggacaucggggugccccuucuggcucugggaugcuauagccagguuaauccgcucacccugacagccgcugugcuuaugcuggucgcccauuacgcgauuaucggcccugggcuccaagccaaggcuacccgggaagcccagaaacgcacagcugccggaaucaugaagaaccccaccguggauggcauuguugccaucgaccuggaucccguggucuaugacgcgaaguuugagaaacagcuggggcagauuaugcuccuuauccuguguacgucucaaauucugcucaugagaacaaccugggcucugugcgaaagcaucacacuugccaccggaccucugaccacacucugggagggcuccccgggcaaguucuggaauacgaccaucgcugugucuauggccaacauuuuucgggggagcuaccuggccggagcuggccuggccuucucccucaugaaaagccuugggggaggccgcagagggacaggagcgcagggcgagacccugggcgaaaaguggaaacggcagcugaaucagcucuccaagucugaguucaacacauauaagagaagcgggaucauggaaguggaccgcuccgaggccaaagaaggacugaagcggggcgagaccacgaaacacgcuguuucuagagggacagccaaacuucgcugguuugucgagcggaaucuggugaaacccgaaggaaaggugauugaucucggcugugggagaggaggcuggagcuacuauugcgcuggccugaagaaagucaccgagguuaagggguacaccaaaggaggcccugggcacgaagaacccaucccuauggccacauacggauggaaccuggugaagcuccauuccggcaaagacguguucuuuauucccccugaaaagugugauacccuucugugcgacaucggggagucuagcccgaaucccacaauugaggaaggacgcacgcugcggguccucaaaaugguggagccuuggcugagaggcaaccaauucuguaucaagauccuuaaucccuauaugccuuccguuguggaaacccuggagcagaugcagcgcaagcacggcgggaugcucguccggaacccccugagcagaaauucuacacaugagauguacuggguguccugcggaaccggcaacauuguuagcgcggugaauaugacaucucgcaugcugcucaaccgguuuaccauggcccacagaaaaccgacguaugaacgcgaugucgaccugggggcuggaaccagacacguggccguggagccugaagucgcuaaccuugauaucauuggccagcggaucgagaauauuaagcaugaacacaaauccacauggcauuacgacgaggauaaccccuauaagaccugggccuaccacgggagcuaugagguuaaacccucuggauccgcuagcuccauggugaauggcguggucaagcugcucacaaagccuugggacgugauccccaugguuacccaaaucgccaugacagauaccacgccuuucggccagcagcgcguguuuaaagaaaaggucgacacaagaaccccgaaagcgaagcgggggaccgcccaaauuauggaggugacagcuaaauggcuguggggauuccuuagcagaaacaagaagccccggaucuguacgcgcgaagaguuuaccagaaaaguucggucuaaugccgcuauuggcgccguguucgucgacgaaaaccaguggaauagcgccaaggaggcgguggaggaugaacgcuuuugggaccugguucauaaagagagagaacuccacaagcaggggaaaugcgcuacaugcguguacaacaugaugggaaagcgggagaagaaacugggcgaguucgggaaggccaaaggcucccgcgccaucugguacauguggcugggagcuagauuucucgaguucgaggcccugggcuucaugaaugaagaucacugguuuucucgggagaacagccuuuccggggucgaaggagagggccugcauaagcucggguauauucugcgcgacaucucuaaaaucccuggaggcaauauguacgcugaugacaccgccgggugggauacaagaauuaccgaggacgaucuucagaacgaagcgcggaucacagacauuauggagcccgaacacgcccugcucgcuaagagcaucuucaaacugaccuaucaaaauaaggugguccgcgugcagagaccugccaagaacggcacgguuauggaugugauuucccggcgcgaccagagaggaucuggccaggucgggaccuacggacugaauacauuuaccaacauggaggcucaacucauccggcagauggaaagcgagggcaucuucucccccagcgagcuggaaacaccgaaccuugccgagagagugcuggauuggcucgaaaaauaugggguggagcgccugaagcggauggcgauuucuggagacgacuguguugugaaaccuaucgaugacagauuugccaccgcucuuacggcccugaaugauaugggcaagguccgcaaagacauuccccagugggaaccuuccaagggguggaacgauuggcagcaagugcccuucugcagccaucacuuucaccagcucaucaugaaggacggccgggagauuguugugccuuguagaaaucaggaugagcuggucggacgcgcucgggugucucagggcgccggguggucccugagagaaacagcuugccucggaaaaagcuacgcccaaauguggcagcugauguauuuccaucgccgggaccuuagacuggcggccaacgcuaucuguuccgccguccccguggauuggauuccgaccucucgcacaaccuggagcauccacgcccaucaccaguggaugacgaccgaggacaugcucuccguuuggaaucggguguggaucgaagagaacccuuggauggaagauaagacacauauuagcucuuggggcgacguccccuaccuggggaaaagagaggaccaauggugcggaucccuuaucggccugaccgcucgggccacaugggcgaccaauauucagguggcuaucaaccagguuagacgccucauugggaaugagaacuaccuggauuauaugacaagcaugaagcgguuuaaaaaugaaucugaccccgagggcgcccugugguga

SEQ ID NO: 18492 - RNA, 9879 nt, Artificial Sequence
  derived and/or modified CDS sequence (opt5) from DENV-1__KJ649286__SS-prME
agcgugaccaugcugcucaugcugcuucccaccguccuggccuuccaccucacgaccagaggcggggagccucauaugaucguuacaaagcaggaacggggaaaaucccugcuuuuuaagaccucuacaggcgugaacaugugcacccugauugcuauggaccucggggagcugugugaagauacaaugaccuacaaaugcccgcgcaucacggaggccgaacccgacgauauugacuguuggugcaaugcgaccgauacaugggugaccuauggaacauguagccaaaccggcgagcacagacgggacaagcgcuccgucgcucuggccccucauguggggcucggacuggagacgagaacagaaaccuggaugucuagcgagggcgccuggaaacagauccagcggguugaaacaugggcucuuagacaccccggcuucaccgugaccgcccuguuucucgcucaugccauugggacauccaucacgcagaagggaaucauuuucauccugcuuaugcuggucaccccuucuauggcgaugagaugcgugggcauugggaaccgggauuuuguugagggacucagcggcgccacauggguggacgucgugcuggagcacggguccugugugaccacaauggcuaaggauaaacccacccuggacaucgaacuccugaagacggaggucacaaauccugccguucuucgcaaacugugcauugaagcuaagaucagcaacaccaccacagauucuagauguccgacccaaggagaggccacacucguggaggaacaggacgcgaauuucgugugccggcgcacguuugucgauagaggcuggggcaacggguguggacuguucggcaaagggucccuuauuaccugcgccaaguuuaagugcgugacaaaacuggagggaaagaucguucaguacgaaaaucucaaauauagcgugaucgucaccgugcacacaggcgaccagcaucaaguugggaacgagucuaccgaacacggaacgaccgcuacaauuacaccccaggccccuacauccgagauccagcugaccgacuacggcgcucugacgcucgauuguagcccccggacaggccuggacuucaaugaaauggugcuucugaccaugaaggagaaaucuuggcucguccauaagcagugguuucuggaucuuccucugcccuggacauccggggccaccaccagccaagagacauggaaccgccaggaccuccuggugacguucaaaaccgcccacgcuaagaagcaggaagucgugguucugggaucccaagagggcgcgaugcacacagcccucaccggggcuacagaaauucagaccucuggaacgacaaccaucuuugccggccaucugaaaugcagacuuaagauggauaaacugacccucaaggggaugagcuaugugauguguacaggcuccuucaaacuggagaaggaagucguggagacccagcacggaacaguucuggugcaggucaaguacgagggcacggacgccccgugcaaaauuccuuuccuuacccaagaugaaaagggggugacacagaauggacgggugaucaccgcuaaccccaucguuacagacaaagagaagccugucaauauugaagccgagccgcccuuuggcgagagcuauaucguggugggggcgggagaaaaagcucucaagcugucuugguucaagaaaggcuccaccauugggaagauguuugaggccacggccagaggcgcucgccggauggccauccugggagauaccgcuugggacuucggcagcauugggggagucuuuacaucugugggcaaacucguucaucagaucuucgggaccgccuacggagugcuguuuagcggcgucuccuggacaaugaagaucgggauuggcgugcuucugaccuggcucggacugaacucuagaagcacaucccugagcaugaccuguaucgcgguuggccuugugacgcucuaccugggggucauggugcaggccgauucuggaugcguuauuaauuggaaaggccgcgaacugaaguguggguccggaaucuucgugacaaacgagguccacaccuggaccgaacaauauaaguuucaggcugacagcccuaaacggcucucugccgcuauuggcaaggccugggaggagggggugugcggcaucagauccgcgacacgccuggaaaacauuauguggaaacagaucagcaaugagcuuaaccauauccugcucgaaaaugacaugaaguucaccguggucguuggagauguguccggcauucuggcccaggggaaaaagaugauccggccgcaacccauggagcacaaauacucuuggaaaagcuggggaaaggcuaagauuaucggcgccgacgugcagaacuccacguuuauuaucgaugggccuaauacacccgaauguccugacgaucagagagcuuggaacaucugggaggucgaggacuauggauucggcauuuuuaccacaaauaucuggcugaaacuucgcgauucuuacacccaggugugcgaccaccggcucaugagcgccgccauuaaagauuccaaggcuguucaugcggacaugggcuauuggaucgaaagcgagaaaaacgaaacauggaagcuggccagagcuucuuucauugaggugaagaccugugucuggcccaaaucccacacgcuguggagcaauggggugcucgaaucugagaugaucaucccgaagauuuacggaggcccuaucucccaacauaacuaucgccccggguacuucacccagacagccggaccuuggcaccugggcaaacuugagcuggauuuugaccucugcgaagggaccacaguuguggucgaugagcacugcggaaaucggggccccagccugagaaccacgacagugaccggcaagauuauccaugaaugguguugccggucuuguacacugccuccccuucgcuucaaaggggaggacggaugcugguacggcauggagauuagaccgguuaaggaaaaggaggaaaaccucgugaaaagcauggucuccgccgggagcggagagguggacucuuuuucccugggccugcucuguaucagcaucaugauugaagaggugaugcgguccagauggucucgcaagaugcugaugaccgggacccuugcugucuuccugcuccugaucaugggacagcugacauggaaugaucuuauucggcugugcaucaugguuggcgccaacgcgagcgacagaaugggcauggggacgaccuaucucgcucugauggccacauuuaaaaugcgcccuauguucgccgugggacuccuguuuagacggcuuaccucccgcgaggugcugcuccugacaauuggccugucucuugucgcuagcguggaacugcccaauucccucgaggaacugggggauggacucgccaugggcaucaugauucugaaacuucugaccgacuuccaaucucaccagcucugggcggcucugcugagccuuacguuuaucaaaacaaccuguucccugcauuacgccuggaagaccauggccaugguucucagcaucgugucucuguucccccucugcauguccacaaccagccagaagacaacguggcugccuguccuucuggggucucugggauguaaaccgcucaccauguuucugauugcugagaacaagaucuggggcagaaaauccuggccccuuaacgaaggcauuauggccguggggaucguuagcauucugcucucuucccugcucaagaaugaugugccucuggcuggaccccuugucgccggcgggaugcugaucgcgugcuaugugaucagcggauccagcgccgaccugucucucgagaaagcugccgaggucagcugggaagaggaagcugagcacuccggcgccucucauaacauucugguggaaguucaggaugacgggacaaugaagaucaaagaugaggagcgggacgauacccuuacaauucugcucaaggccacccugcucgcugugagcggagucuacccucuguccauccccgcgacgcuuuucgugugguauuuuuggcaaaagaaaaagcagcgcucuggcguucugugggacaccccuagcccucccgaaguggagagagccguccuggaugacggcauuuaccggaucaugcagcgcgggcuccugggaagaucccaggugggcguggggguuuuccaagaaaaugucuuccacacaauguggcacgugacccggggagcugugcuuauguauaaaggcaagcgccuggagcccacaugggccucugucaaaaaggaccucaucagcuacgggggaggcuggagacugcagggcuccuggaacaccggggaggaagugcagguuauugccguggagcccggaaagaauccuaaaaacguccagacagcucccggcacguuuaagaccccggaaggggaggugggagccaucgcgcucgauuucaaaccuggcacaagcgggucucccauuguuaaucgggaaggaaagaucgugggccuguacggcaacggggucgugaccaccuccggaacauauguuagcgcuauugcccaagccaaggcuucucaggagggcccucuucccgagaucgaagacgagguguuuagaaagcgcaaucugacgauuauggaucugcaucccggguccggaaagacccggagauaccucccugccaucguccgcgaagcgaucaaacggaagcugagaacacuuauucuggcuccgacccgcgugguggccagcgagauggccgaagcucucaaaggcaugcccauccgguaucagacaaccgccgucaaguccgagcacacggggaaagagauuguugaccugaugugucaugcuacauucaccaugagacugcucucuccugugcgcgugcccaacuacaauaugaucauuauggaugaagcccacuuuaccgacccuagcuccaucgcggcccggggcuauaucagcacaagagucggaaugggcgaggcugccgcuauuuucaugaccgccacacccccugggucuguggaagccuuuccgcaauccaacgcuguuauccaggaugaggaacgggacauucccgagcgcagcuggaacucuggauacgauuggaucaccgacuucccuggcaagacggugugguuuguccccagcauuaaguccgggaacgauaucgcgaauugccuucgcaagaauggaaagcgggugauccagcugucucgcaaaacauucgacaccgaguaucagaagaccaagaacaaugacugggauuacguugugaccacggacauuagcgaaaugggcgccaacuuuagagcugaucgggucaucgacccuagacgcugccugaagcccgugauucucaaggaugggccggagcgggucauccuggccggcccuaugcccgugaccguugccuccgcugcccaaagacgcggacggauuggcagaaaucagaacaaagaaggggaccaguacaucuauaugggacagccccuuaauaacgaugaggaccaugcgcacuggacagaggcuaagaugcugcucgauaauauuaacaccccugaaggcaucauccccgcccuguucgagccugaacgcgagaaaucugccgcuauugacggggaauaccggcugagaggagaggcccgcaagacauucguggagcucaugagacggggcgaucuuccgguguggcugagcuauaaagucgcguccgaaggguuucaauacagcgaccgcagaugguguuucgauggcgagcggaauaaccagguucuggaagagaauauggacguggaaaucuggaccaaggagggagagcgcaaaaagcucagaccccgguggcuggacgccagaacauauucugauccucuugcucugcgcgaauuuaaggaguucgccgcuggccggagauccgugagcggggaccucauucuggaaaucggaaaacugccccagcaccucacccagcgcgcccaauccgcucuugauaaccuggucaugcugcauaauucugagcagggcgggcgggccuacagacacgcgauggaggaacucccugacacgauugagacacugaugcuucuggcccucaucgcugugcugaccggaggcguuacccuguuuuuccucagcggcaaggggcuuggaaaaacauccaucggccugcugugcgugauggccucuagcaugcuccuguggauggcuuccgucgaaccccauuggauugccgccagcaucauucuugaguuuuuccugauggugcuccugaucccggaaccugaucggcagcgcacaccccaggacaaccaacuggcuuaugucgugauugggcuccuuuuuaugauccugacaguugcggccaaugagaugggacugcucgagacgaccaagaaagaucugggcaucgggcacguggcugucgaaaaccaccaucacgccacaaugcuugacguggaucugcauccugccucugcuuggacccucuacgccguugcgacaaccauuaucacgcccaugaugagacacaccauugagaacacaaccgccaauaucucccugacagcuauugccaaccaggcugccauccugaugggacucgacaagggcuggccuauuagcaagauggauaucggcgugccccuucuggcgcugggguguuacucucaggucaauccgaugacccucacggccgcugugcugaugcuuguggcccauuauacaaucauuggaccuggccugcaagcuaaagccacccgggaagcucagaagcgcacagccgcggggaucaugaaaaaccccaccguugacggaauugucgccaucgaucucgaccccgugguguacgacgcuaaguucgagaaacagcugggccagauuaugcugcucauccuuugcaccucccaaauccugcugaugagaacaacgugggcccucugugaaagcauuacccuggcuacagggccucuuaccacacugugggagggaucuccgggcaaguuuuggaauaccacgaucgccgucagcauggccaacauuuuccggggcuccuaucucgcgggggcuggacuggccuuuucucugaugaaaagccucggcgggggacgcagaggcacaggggcucagggagagacccuuggcgaaaaauggaagcggcagcugaaucagcuguccaaaagcgaguucaacaccuacaagcgcuccggcaucauugaaguugauagaucugaggccaaagaagggcucaagcggggagagacaaccaagcacgccgugagcagaggcacagcuaaacugcgcugguucguggagcggaaucuugucaagcccgaagggaaagugaucgaccugggaugcggcagagggggaugguccuauuacugugccggccucaagaaaguuacggaggugaagggcuauaccaaagggggagcgggccacgaggaaccuauccccauggccacauacggguggaaccuggucaagcugcauucuggaaaggauguguuuuucauuccucccgaaaaaugcgacacccuccuuugugauaucggcgagagcuccccuaauccgacaauugaggaagggcgcacccugcggguucugaagaugguggagcccuggcucagaggaaaccaauuuugcaucaaaauucugaauccuuacaugcccucugucguggaaacgcuugagcagaugcagcgcaagcacggcggcaugcuggugcggaacccucucagcagaaauuccacccaugagauguauugggucagcugugggacaggaaacaucguuucugcugugaauaugaccucccgcaugcugcugaaccgguucacaauggcccacagaaaacccaccuacgaacgcgacguggaucucggcgcugggacacggcacgucgccguggagccggaaguugcgaaccuggacauuaucggacagagaaucgagaauauuaagcaugaacacaagagcaccuggcauuaugaugaggacaacccuuacaaaacgugggccuaucacggcucuuacgaggugaagcccuccgggagcgcuucuuccauggucaauggagugguucgccuucugacaaaacccugggaugugaucccuauggucacccaaauugccaugaccgacacaacgcccuuuggccagcagagaguguucaaggaaaaaguugacacccggacaccuaaggcuaagcgcggcaccgcccaagugauggaggucacagcuagauggcucuggggguuucugagccggaacaaaaagccgagaaucugcacccgggaagaguucacacgcaaagugagauccaaugccgcgauuggagccgucuuuguggaugaaaaccaguggaauagcgcuaaggaggccguugaggacgaacgguucugggaucuugugcaucgcgagagagaacugcacaaacagggcaagugcgcuaccugugucuauaacaugauggggaagcgggagaaaaagcucggagaauuuggcaaagccaaggggucucgcgccaucugguacauguggcugggcgcgagauuccuggaguuugaggcucucggauucaugaaugaagaccacugguucagccgggagaacucccugucuggcguggaaggggagggacuucaucgccugggcuacauccucagagauauuagcaaaauccccgggggaaauauguaugccgacgauacggccggcugggacacccggauuacagaggaugaccugcagaacgaagcuaagaucaccgauauuauggagccugaacacgcccuucuggcuacauccaucuuuaaacucaccuaccaaaauaaggugguucgcgugcagagacccgccaagaacgggacggucauggacgugaucucucggcgcgaucagagaggcagcggacagguuggcacauaugggcugaauaccuucacaaacauggaggcgcaacugauucggcagauggaauccgagggacucuuuucuccuagcgagcuggaaacccccaaccuugccgagagagugcugaauuggcucggcaaauacggggucgaacgccugaagcggauggcuaucuccggagacgacugcguggucaaaccgauugaugacagauucgccacggcucuuaccgcccugaacgauaugggcaaggugcgcaaagacaucccucagugggagcccagcaagggguggaaugauuggcagcaaguuccuuuuuguucucaucacuuccaccagcucauuaugaaggacggccgggaaaucgugguccccugcagaaaccaggaugagcuggugggacgcgcgcggguuucccagggcgccggguggagccugagagagacagcuugucucggaaaaucuuaugcccaaauguggcagcugauguacuuucaucgccgggaccuuagacuggcugccaaugcuaucugcuccgccgugccugucgauugggugcccaccagccgcacaaccugguccauucacgcgcaucaccaguggaugacaaccgaaaacaugcucucuguguggaaucggguuuggaucgaggaaaacccguggauggaggacaagacgcaugucagcuccugggaagaugugccuuaucugggcaaaagagaggaccaauggugugggagccuuauuggacugacagcccgggcuaccugggccaccaauauccagguggccauuaaccaggucagaaagcucaucggcaaugagaacuaccuggacuacaugacaucuaugaaacgcuucaagaaugauuccgaccccgaaggggcucugugguga

SEQ ID NO: 18493 - RNA, 9879 nt, Artificial Sequence
  derived and/or modified CDS sequence (opt5) from DENV-1__KF887994__SS-prME
agcgugaccaugcugcugaugcugaugcccacagcccuugcuuuccaccugacgaccagaggcggggagccucauaugaucguguccaagcaggaacggggaaagucucugcuguuuaagaccagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagaugcuggaggccacagcuagaggcgcccgccggauggcgauccugggagauaccgccugggacuuuggcucuauugggggaguguucacaagcguuggcaaacucguccaucagaucuuugggaccgcuuacggagugcuguucuccggcgugagcuggacgaugaagauugggaucggcguccuucugaccuggcucggacucaauucuagauccacaagccugucuaugaccuguauugccgugggccuuguuacacucuaccugggggugaugguccaggcugauuccggaugcgugaucaacuggaaaggccgcgaacugaagugugggagcggaauuuuuguuaccaaugaggugcacacauggaccgaacaauauaaguuccaggccgacuccccuaaacggcucucugcggccaucggcaaggcuugggaggagggggucugcggcaucagaagcgccacgcgccuggaaaacauuauguggaaacagaucuccaacgagcuuaaucauauucugcucgaaaacgacaugaaguuuacagugguugugggagaugucgcuggcauccuggcccaggggaaaaagaugauucggccgcaacccauggaguacaaauauucuuggaaaagcuggggaaaggccaagaucaucggcgcugacgugcagaauaccaccuucauuaucgaugggccuaacacacccgaauguccugacgaucagagagcguggaauauuugggagguggaggacuacggauuuggcaucuucaccacgaacauuuggcugaaacuucgcgauuccuauacacaggucugcgaccaccggcucaugagcgccgcuaucaaagauucuaaggccguucacgccgacaugggcuacuggaucgaauccgagaaaaaugaaaccuggaagcuggcuagagccagcuuuauugaggugaagacauguaucuggcccaaaucucauacccugugguccaacggggugcucgaaagcgagaugauuaucccgaagauuuauggaggcccuaucucucaacacaauuaccgccccggguacuucacacagaccgcgggaccuuggcaucugggcaaacuugagcuggauuucgaccucugcgaagggacgaccgucgugguugaugagcacugcggaaaccggggccccagccugagaacaaccacagugaccggcaagaucauucacgaaugguguugccgguccuguacgcugccuccccuucgcuuuagaggggaggacggaugcugguauggcauggagauccggccggucaaagaaaaggaggaaaaucucgucaagagcaugguuucugcuggguccggagagguggacagcuucucccugggccugcucuguauuucuaucaugauugaagaggucaugagaagccgcuggucccggaaaaugcugaugacagggacccuugccguguuucugcuccugaucauuggacagcugacauggaacgaucuuaucagacugugcaucaugguuggcgccaaugcuucugaccgcaugggcauggggaccaccuaccucgcccugauggcgacauucaagaugagaccuauguuugcugugggacuccuguuccggcgccuuacgagcagagagguccugcuccugaccauuggccugucccuuauggccucuguggaacugcccaacagccucgaggaacugggggauggacucgccaugggcaucaugauucugaaacuucugacagacuuucaaucccaucagcucugggcuacccugcugagccuuacauucaucaagaccacguuuucucugcacuaugccuggaaaacaauggcuauggugcucuccauugucagccuguucccccucugucugucuaccaccucccagaagacaaccuggcuuccuguucugcuggggagccucggaugcaagccgcugacaauguuucuuaucgccgagaauaaaaucuggggccggcgcucuuggccccugaacgaaggcauuauggcgguggggaucguguccauucuccugagcucccuccugaagaacgaugucccucuugccggaccccugaucgcuggcgggaugcugauugccuguuacgugaucagcggaucuagcgcugaccucucccuggagaaagccgccgagguuucuugggaagaggaagcugagcauagcggcgcgucccacaauauccuuguggaaguccaggaugacgggacgaugaagauuaaagaugaggagagagacgauacccugacaauccuccugaaggccacccuccuggcugugucuggaguuuauccucuuagcauucccgccacacuguucgugugguacuuuuggcagaagaagaagcagcgguccggcguccugugggacaccccuucucccccggaaguggagcgcgccguccucgaugacggcaucuauagaauuaugcagcgggggcugcuuggacgcagccaggugggcguugggguguuccaagaaaacgucuuccauacgauguggcacgugaccagaggagcuguucugauguaccagggcaaacggcucgagccuuccugggccagcgugaagaaagaccugaucucuuacgggggaggcuggagacuccagggcuccuggaauacaggggaggaaguccaggugauugcgguggagcccggaaagaacccuaaaaauguucaaaccgcucccggcacauuuaagaccccggaaggggaggucggagccaucgcccuggauuucaagccuggcacaagcgggucucccaucgugaaccgcgaaggaaaaauugugggccuuuauggcaauggggucgugacgaccuccggaacauacguuagcgcuaucgcccaggcgaaggcuucccaggagggcccucugcccgagauugaagacgagguguuucggaaaagaaaccugaccaucauggaucuccaccccgggucuggaaagacccgccgguaucugccugccauugucagagaagccaucaaacgcaaacuucggacacugauccucgcuccgacgagagugguugccagcgagauggcugaagcccugaagggcaugcccauucgcuaccaaaccacagcggugaaauccgagcauaccgggaaggagaucgucgaccugaugugccacgccacauucaccaugcggcuccuuagcccugugagaguucccaauuauaacaugauuaucauggaugaagcucauuuuacggacccuucuuccauugccgcucggggcuacaucagcacacgcgugggaaugggcgaggccgccgcuaucuucaugaccgcgacacccccugggucugucgaagccuuuccgcagagcaaugcugugauucaggaugaggaaagagacauccccgagcgguccuggaacucuggauaugaguggauuacagauuucccuggcaaaaccgugugguuuguccccagcaucaaguccgggaaugacauugccaacugucugcgcaaaaauggaaagagaguuauccagcugucucggaagacauucgauaccgaauaccagaagacgaagaacaacgacugggacuacguggugacaaccgauauuagcgagaugggcgccaauuuuagagcugaccgcgucaucgauccucggagaugccucaaacccgugauccugaaggacgggccggaacgcguuauucuugccggcccuaugcccgugacagucgcguccgcugcccagcggagaggacgcaucggccggaaccacaauaaagagggggaucaguauauuuacaugggacagccccugaacaaugacgaggaucaugcccacuggaccgaagcuaagaugcuccuggacaacaucaauacgccugagggcauuauccccgcccuguucgaaccugagagagaaaagagcgcggccaucgauggggaguaucgccucagaggagaggcucggaaaaccuucguggaacuuaugcgcagaggcgaccugccgguuuggcugucuuacaagguggccuccgagggguuucaauauagcgaucggcgcuggugcuucgacggcgaaagaaacaaucagguccucgaggaaaacauggauguggagauuuggacaaaagagggagaacggaagaaacugagaccccgcuggcuugacgcucggaccuacuccgacccucuggcccucagagaguuuaaggaguucgcugccggccgccggucugucagcggggaucugauccuggagauuggaaaacucccccagcaccuuacacagagagcgcaaaaugcccuggacaaccuggugaugcuccauaauuccgaacagggcgggcgggcuuaucgccacgccauggaggagcugccugauaccaucgaaacacuuaugcugcucgcucugauugccguucugaccggaggcgugacgcucuuuuuccuuucuggcagagggcugggaaagacaagcaucggccugcucugugugauggccuccagcguccugcuuuggauggcuucuguugagccccauuggaucgcggccuccauuauccuggaauuuuuccucauggugcugcugauuccggagccugaccggcagcgcacaccccaagauaaccaacucgcuuacguggucaucgggcuucuguuuaugauucugaccguggccgccaaugagaugggacuccuggaaaccaccaagaaagaccuuggcaucgggcacguugcugugggaaaccaccaucacgccgcgaugcuggaugucgaccuccauccugccagcgcuuggacacuguacgccguggcuacgaccauuaucacacccaugaugagacacaccaucgagaacacaaccgccaauauuucucugacggcgaucgccaaccaggcugccauucucaugggccuugauaagggcuggccuaucuccaaaauggacauuggggucccccugcuggcucucggaugcuauagccaggugaauccgcugacccuuacagccgcuguucugaugcucguggcccauuacgcgaucaucggcccugggcugcaagccaaggcuacccgggaagcccagaaacgcacagcugccggaauuaugaagaaccccaccgucgauggcaucguggccauugaccuggaucccguuguguaugacgcgaaguucgagaaacagcucgggcagaucaugcuucugauucuguguacgucucaaauccuccugaugagaacaaccugggcucuuugcgaaagcaucacacuggccaccggaccucucaccacacugugggagggcuccccgggcaaguuuuggaauacgaccauugcugucucuauggccaacaucuuccgggggagcuaccuggccggagcuggccucgccuuuucccuuaugaaaagccucgggggaggccgcagagggacaggagcgcagggcgagacccugggcgaaaaguggaaacggcagcucaaucagcuguccaagucugaguucaacacauauaagagaagcgggauuauggaaguggaccgcuccgaggccaaagaaggacuuaagcggggcgagaccacgaaacacgcugugucuagagggacagccaagcugcgcugguucguugagcggaaucucgucaaacccgaaggaaaggugaucgaucugggcugugggagaggaggcuggagcuacuauugcgcuggccugaagaaagugaccgaggucaagggguacaccaaaggaggcccugggcacgaggaacccauuccuauggccacauacggauggaaccucguuaaacuucauuccggcaaagacguguuuuucauucccccugaaaagugugauacccugcugugcgacaucggggagucuagcccgaaucccacaaucgaggaaggacgcacgcuccgggugcugaaaauggucgagccuuggcuuagaggcaaccaauuuuguaucaagauucugaaucccuauaugccuuccgugguugaaacccucgagcagaugcagcgcaagcacggcgggaugcuggugcggaacccccugagcagaaauucuacacaugagauguacugggucuccugcggaaccggcaacaucgugagcgcgguuaauaugacaucucgcaugcuccugaaccgguucaccauggcccacagaaaaccgacguaugaacgcgauguggaccuuggggcuggaaccagacacgucgccguggagccugaaguggcuaaccuggauauuaucggccagcggauugagaauaucaagcaugaacacaaauccacaugguacuaugacgaggauaaccccuacaagaccugggccuaucaugggagcuacgaggucaaacccucuggauccgcuagcuccaugguuaauggcguggugaagcuccugacaaagccuugggacgucauccccauggugacccaaauugccaugacagauaccacgccuuuuggccagcagcgcguuuucaaagaaaagguggacacaagaaccccgaaagcgaagcgggggaccgcccaaaucauggaggucacagcuaaauggcuuuggggauuucugagcagaaacaagaagccccggauuuguacgcgcgaagaguucaccagaaaagugcggucuaaugccgcuaucggcgccguuuuuguggacgaaaaccaguggaauagcgccaaggaggcggucgaggaugaacgcuucugggaccucgugcacaaagagagagaacugcauaagcaggggaaaugcgcuacaugcguuuacaacaugaugggaaagcgggagaagaaacugggcgaauuugggaaggccaaaggcucccgcgccauuugguauauguggcucggagcuagauuccuggaguuugaggcccuuggcuucaugaaugaagaucacugguucucucgggagaacagcuuuuccgggguggaaggagagggccugcacaagcucggguacauccugcgcgacaucucuaaaauuccuggaggcaauauguaugcugaugacaccgccgggugggauacaagaaucaccgaggacgaucuucagaacgaagcgcggauuacagacaucauggagcccgaacaugcccugcucgcuaagagcauuuucaaacugaccuaccaaaauaaggucgugcgcguccagagaccugccaagaacggcacggugauggauguugugucccggcgcgaccagagaggaucuggccaggucgggaccuauggacugaauacauuuaccaacauggaggcucaacucauccggcagauggaaagcgagggcaucuucucccccagcgagcuggaaacaccgaaccuugccgagagagugcuggcguggcucgaaaaauacgggguggagcgccugaagcggauggccauuucuggagaugacuguguugugaaaccuaucgacgauagauuugcuaccgcccuuacggcucugaaugacaugggcaagguccgcaaagauauuccccagugggaaccuuccaagggguggaacgacuggcagcaagugcccuucugcagccaccauuuucaccagcucaucaugaaggauggccgggagauuguugugccuuguagaaaucaggacgagcuggucggacgcgcccgggugucucagggcgcuggguggucccugagagaaacagccugccucggaaaaagcuaugcgcaaauguggcagcugauguacuuccaccgccgggaucuuagacuggccgcuaacgccaucuguuccgccguccccgugaauuggauuccgaccucucgcacaaccuggagcauccaugcucaccaucaguggaugacgaccgaggacaugcucuccguuuggaaccggguguggaucgaagagaauccuuggauggaagauaagacacacauuagcucuuggggcgacguccccuaccuggggaaaagagaggaucaauggugcggaucccuuaucggccugaccgcccgggcgacaugggcuaccaacauucagguggccaucaaucagguuagaaagcucauugggaacgagaauuaucuggacuacaugacaagcaugaaacgcuuuaagaacgaaucugaccccgagggcgcccugugguga

SEQ ID NO: 18494 - RNA, 9879 nt, Artificial Sequence
  derived and/or modified CDS sequence (opt5) from DENV-1__JQ675358__SS-prME
agcgugaccaugcugcucaugcugcuucccacagcucuggcuuuccaccucacgaccagaggcggggaaccucauaugaucgucuccaagcaggaacggggaaaaucucugcuuuuuaagacaagcgcuggcguuaacaugugcacccugauugcgauggaccucggggaacugugugaagauacaaugaccuacaaaugcccccaaaucacagaggcugaacccgacgauguggacuguuggugcaaugccaccgauacgugggugaccuauggaacauguucccagaccggcgagcacagaagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagcggucuuggcuggugcauaaacaaugguuucuugaccugccucuccccuggacguccggggcuagcacaucccaggagaccuggaaucgccaggaucugcuggucacauucaagaccgcgcacgccaaaaagcaagaaguggucgugcucggaucucaggagggcgcuaugcacaccgcccugacaggggccacggaaauccagaccagcggaacaaccacaauuuuugcuggccaucuuaagugcagacugaaaauggacaagcucacccugaaagggacguccuauguuauguguacaggcagcuucaagcuggagaaagaaguggccgagacccagcacggaaccguccuugugcaaguuaaguacgagggcacagaugcgccgugcaagaucccuuucucuacccaggacgaaaaaggggugacacagaacggacggcucaucacggcuaaucccauugucaccgauaaggagaaaccugugaacaucgaaacagagccgcccuuuggcgaguccuauauugugguuggggccggagaaaaggcccugaaacugagcugguucaagaagggcucuagcaucgggaaaauguuugaggcuaccgccagaggcgcucgccggauggccauucucggagacacagcgugggauuucggcuccaucgggggagucuuuaccucugugggcaagcuggugcaucaggucuucgggacggccuacggagugcuuuuuagcggcguuuccuggaccaugaaaaucgggauuggcauccugcucacauggcugggacugaauagcagaucuaccucccuuagcaugacauguauugcugugggcauggucacccucuaccugggggugaugguucaagccgacucuggaugcgugaucaacuggaagggccgcgaacugaaauguggguccggaauuuucgucacaaacgaggugcacaccuggacggaacaguauaaguuucaggcugauagcccuaagcggcucuccgccgcgaucggcaaagccugggaggaggggguuugcggcauuagaucugcuacacgccuggaaaauaucauguggaagcagaucagcaacgagcuuaaucauauucugcucgaaaacgacaugaaauucaccguggucgugggagacgccaauggcauccuggcucaagggaagaaaaugauucggccgcagcccauggagcacaaguacuccuggaaaucuuggggaaaggccaagaucauuggcgccgauauccagaacaccacauuuaucauugacgggccugauacccccgaauguccugacaaucagagagcuuggaacaucugggagguggaggauuauggauucggcauuuuuacgacaaauaucuggcugaaacuucgcgacagcuacacccaaaugugcgaucaccggcucauguccgcggccauuaaggacagcaaagcuguccaugccgauaugggcuauuggaucgaaucugagaagaacgaaacauggaaacuggccagagcuuccuucaucgagguuaagaccuguacauggcccaagagccacacccuguggucuaauggggugcucgaauccgagaugauuaucccgaaaacguacggaggcccuauuagccagcauaacuaucgccccggguacuucacccagacagccggaccuuggcaccugggcaaacuugagcuggacuuugaucucugcgaagggaccacaguggucguggacgagcacugcggaaaucggggccccucucugagaaccacgacaguuaccggcaaaaucauucaugaaugguguugccggagcuguacacugccuccccuucgcuucagaggggaggauggaugcugguacggcauggagauccggccggugaaggaaaaagaggaaaaccucgucagauccauggugagcgcggggucuggagagguugacuccuuuagccugggcauccugugugcuuccauuaugaucgaagaggugaugcgcucucgguggagcagaaagaugcucaugaccgggacccuggccgucuuccuucugcucauuaugggacaacugacauggaaugaccugauccgccuuugcauuauggugggcgccaacgcuuccgauagaaugggcauggggacgaccuaucuggcccucauggcgacauuuaagaugcggccuauguucgcuguuggacugcucuuucgcagacugaccucucgggaggugcuucugcucacaaucggccugagccuggucgccuccguggaacuucccaacucucuggaggaacucggggacggacuggccaugggcauuaugaugcucaaacugcuuaccgaguuccagccccaccagcuguggacgacacuccugagccugaccuuuaucaagaccacacuuucccuggauuacgcuuggaaaaccacagccauggcucucagcaucgugucucuguucccucucugucuguccacgaccagccagaagacaaccuggcuuccgguccugcuggggucuuuuggaugcaaaccccucacaauguuccugauuaccgaaaauaagaucuggggccgcaaguccuggccucuuaacgagggcauuauggccaucgggauuguuagccugcuccugucuucccuccugaaaaaugacgugccccuugcgggaccucugaucgccggcgggaugcugaucgcuuguuaugugauuagcggauccagcgccgaucucucucuggagaaggcugccgaagucagcugggagcaagaagccgagcauuccggcacgucucacaacauccuuguggaaguucaggacgaugggaccaugaaaauuaaggacgaggagagagaugacacacugaccauccucgugaaagcuacacugcucgcggucagcggaguguaccccauguccauuccugccacccuguuuguuugguauuucuggcagaagaaaaagcagcggucuggcgugcuuugggauacacccagcccgccugaagucgagcgcgcugugcuggacgauggcaucuacagaauccugcaacgggggcuccugggacgcucccaggucggcguggggguuuuccaggacggaguguuucauacgauguggcacgucaccagaggcgccgugcuuauguaucaggggaagcggcuggaacccucuugggccagcguuaaaaaggaccucauuuccuacggaggcggcuggagauuccaagggagcuggaauacaggagaggaggugcaggucaucgcuguggaaccucgcaaaaaccccaagaaugugcagaccaccccgggcacauuuaaaacgccugagggggaaguuggagccauugcgcuggauuucaagcccggcaccucuggguccccuaucgucaaccgggagggaaagauugugggccucuacggcaaugggguggucacaaccagcggaacauaugugucugcuaucgcccaagccaaggcuucccaggaaggcccccugcccgagauugaggacgaaguuuuuaagaaaagaaaccuuaccaucauggaucugcacccugggagcggaaagacgcgccgguaccugccggccaucgugagagaggcgauuaaacgcaagcuccggacacugauccuugcucccaccagagucguggccuccgaaauggccgaggcucugaagggcaugccuauucgcuaucagaccacagccguuaaaucugaacauaccgggcgggagaucguggaccucaugugccacgcuacauucaccaugagacugcugagccccguccgggugccuaauuacaacaugauuaucauggaugaggcccauuuuacggaccccgcguccaucgccgcucgcggcuauauuagcacaagaguuggaaugggcgaagccgcugccaucuucaugaccgccacaccuccggggucuguggaggcuuuuccccaguccaaugcggucauucaagaugaagaacgggacaucccugaacgcagcuggaacucuggauacgauuggauuaccgacuuccccggcaagacggugugguuugugccuagcaucaaauccgggaaugauaucgccaacugucucagaaagaacggaaaacgggucauucagcuuucuagaaagaccuucgacacagaguaucagaagaccaaaaauaacgacugggauuacguugugacaaccgacaucagcgagaugggcgcuaauuuccgcgccgaucgggugauugaccccagacgcugccugaagccggucauccugaaagaugggccugaacgggugauucucgccggccccaugcccguuacaguggcuuccgccgcgcagagacgcggacggaucggcagaaaccaaaauaaggagggggaccaguacgucuauaugggacagccucugaacaaugaugaagaccacgcucauuggaccgaggccaaaaugcuucuggauaacauuaauacgcccgagggcaucaucccugcccucuuugaaccggagcgcgaaaagucugcugccauugacggggaguacagacugcggggagaagcgcgcaagacauucguggagcugaugagacggggcgaucuccccguuuggcuuagcuauaaaguggccuccgagggguuucaguacagcgaccgcagauggugcuucgauggcgaacggaacaaucaaguccuggaggaaaacauggacguggagaucuggaccaaggaaggagagcgcaagaagcugcgcccucgguggcucgacgcuagaaccuauucugauccccuggcccuucgcgaguuuaaagaguucgcugccggccggagauccgucagcggggaccugauucucgagaucggaaagcugccucagcaccugacacuccgggcucagaaugcccuugauaaccuggugaugcugcacaauuccgaacagggcgggaaagcguaccgccaugccauggaggaacuccccgacaccauugagacacugaugcuucuggcucucaucgccguucugacgggaggcgugacccuguuuuuccucucuggcaaggggcuuggaaagacaagcaucggccugcugugugugaccgcuuccucugcccuccuguggauggccagcgucgagccgcacuggauugcugcguccaucauucuugaauuuuuccugaugguucuccugaucccugagcccgauagacaacggacaccucaggacaaccagcuggccuauguggugauugggcuccuuuuuaugauccugaccgucgcugccaacgaaaugggacugcucgagacgaccaaaaaggaucugggcaucgggcauguggccgcugagaaucaccaacacgccacaaugcuugacguugaucugcgccccgcgagcgccuggacccucuacgcuguggccacaaccgucauuacgccuaugaugagacauacaaucgaaaacaccacagcuaauauuucucugaccgccaucgcgaaccaggccgcuauucugaugggacucgacaaaggcuggcccaucuccaagauggauauuggcgugccgcuucuggcccuggggugcuacagccaggucaauccucucacccugacagcugccgugcuuaugcugguugcucacuaugccaucaucggacccggccuccaggcgaaagccacgcgggaggcucaaaagcgcaccgccgcugggauuaugaagaaccccacaguggacggaaucgucgccauugaucuggacccugugguuuacgacaccaaauucgaaaagcagcugggccagaucaugcuccuuauucuguguacaucucagauccugcucaugagaaccacgugggcccugugcgaguccaucacacuugcgaccgggccgcugaccacacucugggaaggaagccccggcaaauuuuggaauaccacaauugcugugucuauggccaacaucuuccggggcagcuaucuggcuggggccggacuggccuucucccucaugaagucugucggcgggggacgcagaggcaugggggcucaaggagagacgcuuggcgagaaauggaagcggcagcugaaucagcugagcaaguccgaauuuaacaccuacaaaagaagcggcauuauggagguggaucgcuccgaagccaaggaggggcucaaacggggagaaacaaccaagcaugcggugucuagaggcacagccaaacugcgcugguucguugagcggaaucuugucaagccugaggggaaggugaucgaccugggauguggcagagggggauggagcuauuacugcgcuggccucaaaaaggugaccgaagucaaaggcuauacgaaagggggacccggccacgaggaaccuauucccauggccaccuacggguggaaccugguuaaacugcauuccggaaaggauguguuuuucaugccuccggagaaaugugacacacuccuuugcgauaucggcgaaucuagccccaauccuaccaucgaggaggggcgcacacugcgggugcugaagauggucgaacccuggcucagaggaaaccaguuuuguauuaagauccugaauccuuacaugcccuccgugguugagacccuugaacaaaugcagcgcaaacacggcggcaugcuggugcggaacccgcucucuagaaauagcacacacgagauguauugggucuccugcgggaccggaaacauugugagcgcuguuaacaugacgucucgcaugcugcugaaucgguucacaauggcccauagaaagccuaccuacgagcgcgacguggaucucggcgcggggaccagacacgucgccguggaacccgagguggcuaaccuggacaucauuggacagcggaucgaaaauauuaaaaacgagcauaaguccacauggcacuaugaugaagacaaucccuacaaaacgugggccuaucacggcagcuacgaggucaagccuucuggguccgcuagcucuaugguuaacggaguggugcgccuucugaccaagcccugggaugucaucccuauggugacacaaaucgccaugaccgacacaaccccguuuggccagcagagaguuuucaaagagaagguggacacacggacccccagagcuaaacggggcacgacccagauuauggaagucacagccaaguggcucuggggguuucugucccgcaauaaaaagccuagaaucuguacccgggaggaguucacacgcaaggugagaagcaacgcggccauuggagcuguuuuuguggaugagaaucaauggaacuccgccaaagaagcugucgaggacgagcgguucugggaucuugugcaucgcgaaagagagcugcacaagcagggcaaaugcgcgaccugcguuuauaauaugauggggaagcgggagaaaaagcucggagaguuuggcaaggccaaagggagccgcgccaucugguacauguggcugggcgcuagauuccuggaguucgaggcccucggauuuaugaacgaggaccauugguucucucgggaaaauagccuguccggcguggagggggaaggacuucacaagcugggcuacauucuccgcgauaucucuaaaauccccgggggaaacauguaugccgacgauacggcuggcugggacacaagaauuaccgaggaugaccugcagaaugaggccaagaucacagauauuauggaaccugagcaugcccuucuggccaccagcaucuuuaaacucacguaccagaacaaggucgugcggguccaacgccccgcgaaaaacgggaccgugauggacguuauuuccagacgggaucagagaggcucuggacaggugggcacauaugggcugcacaccuucacaaauauggaaguccagcugauccgccaaauggagagcgaaggaaucuuucucccguccgagcuggagaccccuaaccuugccgaacgggugcuggacuggcucgagaagcacggcgcugaaagacugaagcgcauggccauuucuggggacgauugugugguuaaacccaucgacgaucgguucgcuacagcccuuaccgcgcugaaugacaugggaaaggugagaaaagauauuccucagugggagcccagcaagggcuggaacgacuggcagcaggucccuuuuugcucccaucacuuccaucaacucaucaugaaagaugggcgcgaaauugugguucccugucggaaucaggacgagcuggugggcagagcccgcgucagccagggagcuggcuggucucugcgggagacggccugccucgggaaguccuacgcucaaauguggcagcugauguauuuucacagacgcgaucuucggcuggccgcuaacgccaucuguagcgcggugccggucgacugggugccuacaucuagaaccaccugguccauccacgcccaucaccaguggaugacaaccgaagauaugcucagcguuuggaaucggguguggauugaggaaaaccccuggauggaggacaagacacaugucuccucuugggaagaggugcccuaccugggaaaaagagaggaccaguggugcggcagccuuaucgggcugacggcucgcgccaccugggccacaaauauucaaguugcuaucaaccaggugcggagacucauuggaaaugaaaacuaucuggauuacaugaccuccaugaagcgcuucaaaaaugagagcgacccugaaggcgcccugugguga

SEQ ID NO: 18495 - RNA, 9879 nt, Artificial Sequence
  derived and/or modified CDS sequence (opt5) from DENV-1__FJ850070__SS-prME
agcgugaccaugcugcugaugcugcuucccacagcccuggcuuuccaccucacgaccagaggcggggaaccucauaugaucgucuccaagcaggaacggggaaaaucucugcuuuuuaagacaagcguuggcgugaacaugugcacccugauugccauggaccuuggggaacugugugaagauacaaugaccuacaaaugccccagaaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagaacaagaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccgcccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacgcuaauggcauccuugcccaggggaagaaaaugauucgcccgcaacccauggagcauaaguauagcuggaaguccuggggaaaagcuaagaucauuggcgccgauauccagaacaccaccuuuaucauugacgggccugauacacccgaauguccugacgaucagcgggccuggaauaucugggagguggaggacuacggauucggcauuuuuaccacgaacaucuggcucaaacugagagauucucacacacagaugugcgaccaccgccugaugagcgcugcgauuaaggauuccaaagccguccaugcugacaugggcuauuggaucgaaagcgagaagaaugaaaccuggaagcucgcccgggccucuuucaucgagguuaaaacauguauuuggcccaagucccacacccuguggagcaacggggugcuugaaucugagaugaucauuccgaaaaucuacggaggcccuauuucccaacauaauuauagacccggguacuucacacagaccgcuggaccuuggcaccugggcaagcucgagcuggauuuugaccugugcgaagggacgaccguggucguggaugagcacugcggauaccgcggccccagccuucggacaaccacaguuaccggcaaaaucauccaugaaugguguugcagaucuuguacgcucccuccccugcgguuccgcggggaggacggaugcugguauggcauggagauuagaccggugaaggaaaaggaggaaaaccugguccggagcaugguguccgccgggagcggagagguugacucuuuuucccucggcauccugugugugagcauucuuaucgaagaggucaugagaucccgcuggucucggaaaaugcugaugacagggacccucgcgguguuccugcugcuuauuaugggacagcugacauggaaugaucucaucagacugugcauuaugguuggcgcuaacgccagcgaccgcaugggcauggggaccaccuaccucgcccugauggcuacauuuaagaugagaccuauguucgccgugggacuucuguuucggcgccucacguccagagagguccugcugcuuaccaucggccugucucucguggcgagcguggaacugcccaauucccucgaggaacugggggauggacuugcuaugggcaucaugaugcugaaacuccugacagacuuccaaccccaccagcuguggaccacacuucugucucucaccuuuauucggacgagccugucccucgauuaugccuggaagacaauggccauggcucugagcaucgucucucuuuucccucugugucuguccaccaccagccagaaaacaaccuggcucccgguucugcuugggucuuuuggaugcaagccccugacaauguuccucauuacggagaacaagaucuggggccgcaaauccuggccuauuaacgaaggcaucauggccguggggaucgugagcauucugcucucuucccugcuuaagaaugacgucccccuggcuggaccucugaucgccggcgggaugcucauugcguguuacgugaucagcggauccagcgccgaucugucucuugagaaagcugccgagguuagcugggaagaggaagcugagcauuccggcaccucucacaacauucugguggaaguccaggacgaugggacaaugaagaucaaagacgaggagagagaugacacccucacaauccugcucaaggccacccugcuugccgcuagcggaguguaucccauguccauuccugcgacgcuguuuguuugguacuucuggcagaagaagaagcagcggucuggcgugcugugggauacccccagcccgccugaagucgagcgcgccgugcucgacgacggcaucuaucgcauucugcagcgggggcuucugggacgcucccaggucggcguggggguuuuccaagauggaguguuucauacaauguggcacgucaccagaggcgcugugcucauguaccaggggaaacggcuggaacccucuugggccagcguuaagaaagaccucaucuccuacggaggcggcuggagauuccaggggagcuggaauacaggagaggaggugcaggucauugccguggaaccuggcaagaaccccaaaaaugugcaaaccacaccggggacguuuaagaccccugagggagaaguuggcgcuaucgcccuggauuucaagcccgggacaucuggauccccuauugucaaccgcgagggcaaaaucgugggccuuuaugggaauggaguggucaccaccagcggcacauacgugucugcgaucgcucaggccaaggccucccaggaagggccccugcccgagauugaggacgaaguuuuuaaaaagcggaaccugacgaucauggaucuccacccuggaagcggcaaaaccagacgcuaucugccggcuauugugcgggaggccaucaagagaaaacuucgcacacugauucucgcgcccacccgggucguggcuuccgaaauggccgaggcccugaaagggaugccuaucagauaccaaacaaccgcuguuaagucugaacauacgggccgcgagaucguggaccugaugugccacgccacauucaccaugcggcuccuuagccccgucagagugccuaauuauaacaugauuaucauggaugaggcucauuuuaccgaccccgccuccauugcggcccggggauacaucagcacacgcguuggcaugggggaagcugccgcuauuuucaugaccgccacaccuccgggaucuguggaggccuuuccccaguccaaugcugucauccaggaugaagagagagacaucccugaacggagcuggaacucuggcuaugauuggauuaccgacuuccccgggaaaacggugugguuugugccuagcaucaaguccggaaaugacauugcgaacugucugcgcaaaaauggcaagagagucauccagcugucucggaagacauucgauaccgaguaccagaagacaaagaacaacgacugggauuacguugugaccacggacauuagcgagaugggggccaauuucagagcugaucgcgugaucgacccccggagaugccucaaaccggucauucugaaggauggcccugaacgcgugauccuugccggacccaugcccguuaccguggccuccgcugcccagcggagaggccgcaucgggcggaaccagaauaaagagggagaccaguauauuuacaugggccaaccucugaacaaugaugaagaccacgcgcauuggacagaggcuaagaugcuccuggauaacaucaauacccccgaggggauuaucccugcccuguuugaaccggagagagaaaagucugccgcuauugacggagaguaucgccucagaggcgaagcccggaaaacauucgucgagcuuaugcgcagaggggaucugcccguguggcugagcuacaagguugcguccgagggcuuucaguauagcgaccggcgcuggugcuucgacggagaaagaaacaaucaggugcucgaggaaaacauggaugucgagaucuggaccaaagaaggcgagcggaagaaacugagaccucgcuggcuugacgcccggacauacucugauccccuggcucucagagaguuuaaggaguucgccgcugggcgccgguccgugagcggagaccugauccuggagauuggcaaacucccucagcaccuuacccugagagcccaaaaugcucuggauaaccucgucaugcugcacaauuccgaacaagggggaaaggccuaucggcaugcgauggaggaacuucccgacacgaucgagacacugaugcuccuggcccugauugcugugcucaccggcggcguuacccucuuuuuccugucugggaagggacugggcaaaacaagcaucgggcuccugugugugauggccuccucugcccuucuguggauggccagcguggagccgcacuggauugccgcuuccaucauccucgaauuuuuccugaugguccugcucauuccugagcccgaucgccagagaaccccucaggacaaccaacuugcguacguugugaucggacugcuguuuaugauucucacaguggccgcuaaugaaaugggccugcuugagacgaccaagaaagaucuggggaucggacaugucgccgccgagaaccaccaccaugcuacaaugcucgacguggaucugcaccccgccagcgcguggacccuguacgccguugcuacaaccgugauuacgccuaugaugcggcauaccaucgaaaacacaaccgccaauauuucucucacagcuaucgccaaccaggcggccauccuuaugggccuggacaagggcuggcccauuuccaaaauggauaucggggucccgcugcucgcucugggaugcuauagccaggugaauccucuuacccugacggccgcuguccucaugcugguggcccacuacgcuauuaucggccccgggcugcaagccaaggcgacacgcgaggcccagaagagaaccgcugccggaauuaugaaaaaccccacaguugacggcaucgugaccaucgaccucgauccugucguguaugacgcuaaguucgaaaaacagcuugggcagauuaugcugcugauccucuguaccucucaaauucugcuuaugcggacaacgugggcccugugcgaguccaucacccucgccacaggaccgcugaccacacugugggaaggcagccccggcaaguuuuggaauaccacgauugcgguuucuauggcuaacaucuuccgcgggagcuaccucgccggagcuggccuugccuucucccugaugaaaucucucgggggaggcagacgggggacaggagcccagggcgagacccucggcgagaaguggaagcgccagcugaaucagcuuagcaaauccgaauuuaacaccuauaagaaaagcgggaucauggagguggauagauccgaagcuaaggagggacugaaacggggcgaaacaaccaagcaugccgucucuagagggacagcgaagcuccgcugguucguggagcggaaucuggugaaaccugagggaaagguuauugaccugggcugugggagaggaggcuggagcuacuauugcgccggccucaaaaaggucacggaagugaaaggguacaccaagggaggccccgggcacgaggaaccuauccccauggcuacauacggauggaaccuugugaaacugcacuccggcaaggaugucuuuuucaccccuccggagaagugugacacacugcucugcgauauuggggaaucuagccccaauccuaccaucgaggagggacgcacgcugcggguucuuaaaaugguggaacccuggcugagaggcaaccaauuuuguauuaagauccucaauccuuauaugcccuccguggucgagacccuggaacagaugcagcgcaaacauggcgggaugcuggugcggaacccgcucucuagaaauagcacacacgagauguacuggguuuccugcggaaccggcaacauugugagcgccgucaauaugacaucucgcaugcugcuuaaccgguucaccauggcucauagaaagccuacauaugagcgcgacguggaucugggggccggaacccggcacguugcgguggaacccgaggucgccaaccucgacaucaucggccagagaauugaaaauaucaaaaacgagcacaaguccacguggcauuacgaugaagacaaucccuauaagacaugggcuuaccacgggagcuaugaggugaaaucuuccggaagcgccucuuccauggugaacggcgucguucgccugcuuaccaagccuugggacgugauucccauggugacccaaaucgcuaugacagauacgaccccuuuuggccagcagagagucuucaaagagaagguggacacacggaccccgcgcgccaaaagagggacagcucaaauuauggaaguuaccgccaaguggcuguggggauuucucagccggaauaagaaacccagaaucuguacacgggaggaguucacccgcaaggugagauccaacgcggccaucggcgcugucuuuguggaugagaaucaguggaacagcgccaaagaagcuguugaggacgagcgguucugggaucuggugcaucgcgaaagagagcugcacaagcaggggaaaugcgccacgugcgucuacaauaugaugggaaagcgggaaaagaaacucggcgaguuugggaaggccaaaggcucucgcgcgauuugguacauguggcugggagcuagauuccuugaguucgaggcccugggcuuuaugaacgaggaccauugguucagccgggaaaauucccucucugggguggagggagaaggccugcacaaacuuggguauauccugcgcgauauuagcaaaaucccuggaggcaacauguacgccgacgauaccgcugggugggacacaagaauuaccgaggaugaccuccagaaugaggccaagaucacagauaucauggaacccgagcacgcucugcuggccaccuccauuuuuaaacucacguaucaaaacaagguugugcggguccagcgcccugcgaagucuggcacagugauggacgucaucagcagacgggaccagcgcggauccggccagguggggaccuacggacugaauacauucaccaacauggaaguucaacuuauuagacagauggagucugaaggcaucuuuagccccuccgagcuggagacgccgaaccucgccaaacgggugcuggauuggcuugaaaagcauggggcugagagacugaaacgcauggccauuagcggagacgauugugucgugaagccuaucgacgaucgguucgcuaccgcccucacagcgcugaaugacaugggcaaagugagaaaggauaucccccagugggaaccuucuaagggguggaacgacuggcagcaaguucccuuuugcucccaccauuuccaccagcugauuaugaaagauggccgcgagaucguggucccuugucggaaucaggacgaacucgugggcagagcucgcguuagccagggagcuggguggucucugcgggagaccgccugccuuggaaaguccuaugcucaaauguggcagcugauguacuuucacagacgcgaucuccggcuggccgcuaacgccauuuguagcgcggugcccgucgacugggugccgacauccagaaccacauggucuauccaugcccaccaucaguggaugaccacggaggacaugcuuagcgucuggaaucgcguguggauugaagagaacccuuggauggaagauaaaacacacguuuccagcugggaggaagugcccuaucugggcaagcgggaggaccaauggugcgggucucucaucggacugaccgcuagagccaccugggccacaaauauucaggucgcuaucaaccaggugcggagacugaucggcaaugagaacuaccucgauuacaugaccuccaugaaacgcuucaagaaugaaagcgaccccgagggggcccugugguga

SEQ ID NO: 18496 - RNA, 9879 nt, Artificial Sequence
  derived and/or modified CDS sequence (opt5) from DENV-1__FJ850071__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacgcuaauggcauccuugcccaggggaagaaaaugauucgcccgcaacccauggagcauaaguauagcuggaaguccuggggaaaagcuaagaucauuggcgccgauauccagaacaccaccuuuaucauugacgggccugauacacccgaauguccugacgaucagcgggccuggaauaucugggagguggaggacuacggauucggcauuuuuaccacgaacaucuggcucaaacugagagauucucacacacagaugugcgaccaccgccugaugagcgcugcgauuaaggauuccaaagccguccaugcugacaugggcuauuggaucgaaagcgagaagaaugaaaccuggaagcucgcccgggccucuuucaucgagguuaaaacauguauuuggcccaagucccacacccuguggagcaacggggugcuugaaucugagaugaucauuccgaaaaucuacggaggcccuauuucccaacauaauuauagacccggguacuucacacagaccgcuggaccuuggcaccugggcaagcucgagcuggauuuugaccugugcgaagggacgaccguggucguggaugagcacugcggauaccgcggccccagccuucggacaaccacaguuaccggcaaaaucauccaugaaugguguugcagaucuuguacgcucccuccccugcgguuccgcggggaggacggaugcugguauggcauggagauuagaccggugaaggaaaaggaggaaaaccugguccggagcaugguguccgccgggagcggagagguugacucuuuuucccucggcauccugugugugagcauucuuaucgaagaggucaugagaucccgcuggucucggaaaaugcugaugacagggacccucgcgguguucuuucugcugauuaugggacagcuuacauggaaugaucugaucagacucugcauuaugguuggcgcuaacgccagcgaccgcaugggcauggggaccaccuaccuggcccucauggcuacauucaagaugagaccuauguuugccgugggacugcuuuuccggaaacugacgucccgcgagguccuccugcugaccaucggccuuucucugguggcgagcguggaacuccccaauucccuggaggaacucggggauggacuggcuaugggcaucaugaugcuuaagcugcucacagacuuucaaccccaccagcuguggaccacacugcuuucucugaccuucauuagaacgagccucucccuggauuaugccuggaaaacaauggccauggcucucagcaucgucucucuguuuccucuuugucuguccaccaccagccagaagacaaccuggcugccgguucuccuggggucuuucggaugcaagccccuuacaauguuucugauuacggagaacaaaaucuggggccggaaguccuggccuauuaacgaaggcaucauggccguggggaucgugagcauucuccugucuucccuccugaaaaaugacgucccccuugcuggaccucugaucgccggcgggaugcugauugcguguuacgugaucagcggauccagcgccgaucucucucuggagaaggcugccgagguuagcugggaagaggaagcugagcauuccggcaccucucacaacauucuuguggaaguccaggacgaugggacaaugaaaaucaaggacgaggagcgcgaugacacccugacaauccuccugaaagccacccuccuggccgugagcggaguuuaucccauguccauuccugcuacgcuuuucgugugguacuucuggcaaaagaagaaacagagaucuggcguccugugggauacccccagcccgccugaaguggagcgggcgguccuggacgacggcaucuaucgcauucuccagagagggcugcuuggacggucccaggugggcguugggguguuucaagauggagucuuccauacaauguggcacgugacccgcggcgccguucugauguaccaggggaagagacucgaacccucuugggcuagcgugaaaaaggaccugaucuccuacggaggcggcuggcgguuucaggggagcuggaauacaggagaggagguccaggugauugccguggaaccuggcaaaaaccccaagaauguucaaaccacaccggggacguucaagaccccugagggagaagucggcgccaucgcucucgauuuuaaacccgggacaucuggauccccuauugugaacagagagggcaagaucgugggccuguaugggaauggagucgugaccaccagcggcacauacguuucugccaucgcgcaggcuaaagccucccaggaagggccccuucccgagauugaggacgaaguguucaagaaacgcaaccugacgaucauggaucugcacccuggaagcggcaagacccggagauaucucccggccauuguccgcgaggcuaucaagcggaaacugagaacacuuauucuggcccccacccgcgugguugcguccgaaauggcugaggcccucaaggggaugccuauccgguaccaaacaaccgccgugaaaucugaacauacgggcagagagaucgucgaccugaugugccacgcuacauuuaccaugcgccugcucagccccgugcggguuccuaauuauaacaugauuaucauggaugaggcccauuucaccgaccccgcuuccauugccgcgagaggauacaucagcacacgggugggcaugggggaagccgcugccauuuuuaugaccgcuacaccuccgggaucugucgaggccuucccccaguccaaugccgugauccaggaugaagagcgcgacaucccugaaagaagcuggaacucuggcuaugauuggauuaccgacuuucccgggaagacggugugguucgucccuagcaucaaauccggaaaugacauugcuaacugucuucggaagaauggcaagcgcguuauccagcugucuagaaaaacauucgauaccgaguaccaaaagacaaaaaacaacgacugggauuacguggugaccacggacauuagcgagaugggggcgaauuuucgggccgauagagucaucgacccccgccggugccugaagccggugauucucaaagauggcccugaaagaguuauccuggcuggacccaugcccgugaccgucgccuccgccgcucagcgccggggcagaaucgggcgcaaccagaauaaggagggagaccaguauauuuacaugggccaaccucuuaacaaugaugaagaccacgcccauuggacagaggcgaagaugcugcucgauaacaucaauacccccgaggggauuaucccugcucuguucgaaccggagcgggaaaaaucugccgccauugacggagaguauagacugcgcggcgaagcuagaaagacauuuguggagcucaugcggcgcggggaucuucccguuuggcugagcuacaaaguggccuccgagggcuuccaguauagcgacagacgguggugcuuugacggagaacgcaacaaucagguccuggaggaaaacauggauguggagaucuggaccaaggaaggcgagagaaaaaagcuccggccuagauggcuggacgcgcgcacauacucugauccccuugcccugcgggaguucaaagaauuugcugccgggagacgcuccgucagcggagaccucauccuggagauuggcaagcugccucagcaccucacccuucgggcucaaaaugcccuggauaaccuggugaugcuccacaauuccgaacaggggggaaaggcuuauagacaugccauggaggaacugcccgacacgaucgagacacuuaugcugcucgcgcugauugccguucugaccggcggcgugacccucuucuuucuuucugggaaaggacugggcaagacaagcaucgggcugcucugugugauggcuuccucugcccugcuuuggauggcuagcgucgagccgcacuggauugccgccuccaucauccuggaauucuuucucaugguucugcugauuccugagcccgaucggcagcgcaccccucaggacaaccaacucgcuuacguggugaucggacuucuguucaugauucugacagucgcggccaaugaaaugggccuccuggagacgaccaaaaaggaucuugggaucggacauguggcugccgagaaccaccaccaugccacaaugcuggacguugaucucagacccgcuagcgccuggacccuguacgcgguggccacaaccgucauuacgccuaugaugcggcacaccaucgaaaacacaaccgcuaauauuucucugacagccaucgcuaaccaggccgcgauccucaugggccuugacaaaggcuggcccauuuccaagauggauaucggggugccgcugcuggcccucggaugcuauagccaggucaauccucugacccuuacggcugccgugcugaugcucguugcucauuacgccauuaucggccccgggcugcaagcuaaggccacacgcgaggcgcagaaaagaaccgccgcuggaauuaugaagaaccccacaguggacggcaucgucaccaucgaccuggauccugugguuuaugacgccaaauuugaaaagcagcucgggcagauuaugcuucugauccuguguaccucucaaauucuccugaugcggacaacgugggcucuuugcgaguccaucacccuggccacaggaccgcucaccacacugugggaaggcagccccggcaaauucuggaauaccacgauugccgugucuauggcgaacaucuuccgcgggagcuaccuggcuggagccggccucgcuuuuucccuuaugaagucucuggggggaggcagacgggggacaggagcccagggcgagacccugggcgagaaguggaaacgccagcucaaucagcugagcaaguccgaauucaacaccuauaaaaagagcgggaucauggaggucgauagauccgaagccaaagagggacuuaagcggggcgaaacaaccaagcacgcugugucuagagggacagccaaacugcgcugguuuguggagcggaaucucguuaagccugagggaaaagucauugaccugggcugugggagaggaggcuggagcuacuauugcgcgggccugaagaaagugacggaagugaagggguacaccaaaggaggccccgggcaugaggaaccuauccccauggccacauacggauggaaccucgucaagcuucacuccggcaaggauguuuucuuuaccccuccggagaaaugugacacacugcugugcgauauuggggaaucuagccccaauccuaccaucgaggagggacgcacgcuccgggugcugaagaugguggaacccuggcuuagaggcaaccaauucuguauuaaaauccugaauccuuauaugcccuccgucguggagacccucgaacagaugcagcgcaagcacggcgggaugcugguucggaacccgcugucuagaaauagcacacaugagauguacuggguguccugcggaaccggcaacauugucagcgcugugaauaugacaucucgcaugcuccugaaccgguuuaccauggcccacagaaaaccuacauaugagcgcgacguugaucuuggggcuggaacccggcauguggccgucgaacccgagguggcgaaccuggacaucaucggccagagaauugaaaauaucaagaacgagcacaaguccacguggcacuacgaugaagacaaucccuauaaaacaugggccuaccaugggagcuaugaggugaagccuucuggauccgcuagcucuauggucaacggcguugugcgccuccugaccaaacccugggacgugauuccuauggucacccaaaucgccaugacagauacgaccccguucggccagcagagaguguuuaaggagaaaguugacacacggaccccccgcgcuaagagagggacagcccaaauuauggaagugaccgcuaaguggcuuuggggauuccugucccggaauaaaaagccuagaaucuguacacgggaggaauuuacccgcaaagucagaagcaacgccgcgaucggcgccguguucguugaugagaaucaguggaacuccgcuaaggaagccguggaggacgagcgguuuugggaucucguccaccgcgaaagagagcugcauaaacaggggaagugcgcuacgugcguguacaauaugaugggaaagcgggaaaaaaagcugggcgaguucgggaaagccaagggcagccgcgccauuugguacauguggcucggagcgagauuccuggaauuugaggcucuuggcuucaugaacgaggaccacugguuuucucgggaaaauagccuguccgggguugagggagaaggccuccauaaacugggguauauccuucgcgauauuucuaagauccccggaggcaacauguacgccgacgauaccgccgggugggacacaagaauuaccgaggaugaccugcagaaugaggcuaaaaucacagauaucauggaaccugagcacgcccuccuggcuaccagcauuuucaagcugacguaucaaaacaaggugguccgggugcagcgccccgccaaauccggcacagucauggacgugaucucuagacgggaccagcgcggaagcggccagguugggaccuacggacucaauacauuuaccaacauggaagugcaacugauuagacagauggaguccgaaggcaucuucucuccgagcgagcuugagacgccuaaccuggcgaagcggguccucgauuggcuggaaaaacacggggccgagagacuuaagcgcauggcuauuuccggagacgauuguguggugaaacccaucgacgaucgguuugccaccgcucugacagcccucaaugacaugggcaagguuagaaaggauaucccucagugggaacccagcaaaggguggaacgacuggcagcaagugccuuucugcucucaucacuuucaucagcugauuaugaaggauggccgcgagaucgucgugcccugucggaaucaggacgaacugguuggaagagcgcgcgugucccagggcgccggguggagccuccgggagaccgcuugccugggaaaaucuuaugcccaaauguggcagcuuauguacuuccacagacgcgaucugcggcucgcugccaacgcuauuuguuccgccgucccgguggacugggucccuacaagcagaaccacaugguccauccacgcgcaucaccaguggaugaccacggaggacaugcugucuguguggaaucgcguuuggauugaagagaaccccuggauggaagauaagacacaugugagcuccugggaggaaguccccuaucuuggcaaacgggaggaccaauggugcgggagccugaucggacucaccgccagagcuaccugggccacaaauauucagguggccaucaaccagguucggagacugaucggcaaugagaacuaccuggauuacaugaccucuaugaagcgcuuuaagaaugaauccgacccugagggggcucucugguga

SEQ ID NO: 18497 - RNA, 9879 nt, Artificial Sequence
  derived and/or modified CDS sequence (opt5) from DENV-1__FJ850073__SS-prME
agcgugaccaugcugcugaugcugcuucccaccgcucuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcauuacagaggcugaacccgacgauguggacuguuggugcaaugccaccgauacgugggugaccuauggaacauguucccaaaccggcgagcacagacgggacaagcgcucuguugcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaggaacaagaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccgcccuuuggcgaguccuauaucguugucggggccggagaaaaggcccugaagcugagcugguucaaaaagggcucuagcauugggaaaauguuugaggcuaccgcccggggcgcuagacgcauggccauccucggagacacagcgugggauuucggcuccauugggggaguguuuaccucugugggcaagcugguccaucagguguucgggacggccuacggaguucuuuuuagcggcguguccuggaccaugaaaaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagaacugaaguguggguccggaaucuucgugacaaacgagguucacaccuggacggaacaauauaaauuucaggcugauagcccuaagcgccucuccgccgcgauuggccgggccugggaggagggggugugcggcaucagaucugcuacacgccuggaaaauauuauguggaaacagaucagcaacgagcuuaaucauauccugcucgaaaacgacauuaaguucaccgucguggugggaaaugccgacggcauccuggcucaggggaaaaagaugauucggccgcaacccauggagcacaaauacuccuggaagucuuggggaaaggccaaaaucauuggcgccgauauccagaacaccacauuuaucauugacgggccugauacccuggaaugucccgacgagcagagagcuuggaauaucugggaggucgaagauuauggauucggcauuuuuacgacaaacaucuggcuuaagcuccgcgacagcuacacccagaugugcgaucaccggcugauguccgcggccauuaaagacagcaaggcuguucaugccgauaugggcuauuggaucgagucugagaaaaaugagacauggaagcuggccagagcuuccuucaucgaagugaagaccuguauuuggccuaaaagccacacacucuggucuaacggggugcuggaguccgagaugaucauucccaagauguacggaggcccggucagccaacauaauuaucgcccuggguacuucacccagacggccggacccuggcaccuuggcaaacuggaacucgacuuugaucugugcgaggggaccacagugguuguggacgaacacugcggaucucggggcccuagccugagaaccacaaccgucacgggcaagaucauucaugagugguguugccgguccuguacacuucccccucuccgcuucagaggggaggauggaugcugguacggcauggaaauccggcccgugaaagagaaggaagagaaccugguuagaagcauggugucugcgggguccggagaagucgacagcuuuucccugggcgugcucuguguuucuaucaugauugaggaggugaugcgcagccggugguccagaaagaugcugaugaccgggacacuugcugucuuccugcuccugaucaugggacagcugaccuggaaugaccuuauucgccugugcaucauggugggcgccaacgccucugauaaaaugggcauggggaccacauaucucgcucugauggccacguuuaagaugagaccgauguucgcggugggacuccuguuucggcgccuuaccagcagagaaguccugcuccugacaauuggccugucccuuguugcuucuguggagcugccuaauagccucgaagaacugggggacggacucgccaugggcaucaugaugcugaaacuucugaccgaguuccaaccccaccagcucuggacaacccugcugucccuuacguuuauuaagacaacccugagccucgauuacgccuggaaaaccacagcuauggugcugucuaucgucucccucuucccccugugucuuagcaccacaucucagaagacgaccuggcugccugugcugcucggguccuuuggaugcaagccgcugacaauguuccuuaucaccgagaacgagauuuggggccggaaaagcuggccccugaacgaaggcaucauggccauugggaucguuucuauucuccuguccagccuccugaagaaugacgugccucuugcuggaccccugaucgccggcgggaugcugaucgcguguuaugucauuuccggaagcucugccgaucucagccuggagaaagcugccgaaguguccugggaggaagagguugagcauucuggcacaagccacaacauccuuguggaaguccaggacgaugggaccaugaagauuaaagacgaggaacgcgaugacacgcugaccauccuccugaaggcuacacuccuggccguguccggagucuacccuaugucuauucccgccacccuuuuugugugguauuucuggcagaaaaagaagcagagaagcggcguucugugggauacaccuagcccucccgagguggagcgggcuguccuggacgauggcaucuaccgcauccuccagagagggcugcuuggacggucucaggugggcguugggguguuccaagacggagucuuucauaccauguggcacgugacacgcggcgcggugcugauguaucaggggaaaagacucgaacccagcugggccuccguuaagaaagaccugauuagcuacggaggcggcuggcgguuccaggggucuuggaauacgggagaggaaguccaggugaucgcuguggagcccggcaagaacccuaaaaauguccaaaccacacccgggaccuuuaagaccccggaaggagaggugggcgccauugcccucgauuucaagccugggacauccggaagccccaucguuaacagagagggcaaaauugugggccuguacgggaauggagucgugacgaccucuggcacauauguuuccgcuaucgcccaggcgaaggcuagccaggaagggccucuucccgagauugaagacgagguguuuaaaaagcgcaaccugaccaucauggaucugcaccccggauccggcaaaacacggagauaccucccugccaucguccgcgaagccauuaagcggaagcugagaacccuuauccuggcuccgacgcgcgugguugccucugagauggcggaggcucucaaagggaugcccauucgguaucaaacaaccgccgugaaguccgaacauaccggcagagagaucgucgaccugaugugccacgccacauucaccaugcgccugcucuccccugugcgggugcccaauuacaacaugauuaucauggaugaagcucauuuuacagacccugccagcaucgcugccagaggauauauuucuacccgggucggcaugggggaggcggccgcuaucuucaugacggccacacccccuggauccguugaggcuuuuccgcagagcaaugccgugauucaggaugaggagcgcgacauccccgaaagaucuuggaacagcggcuacgauuggauuaccgacuucccugggaaaacagugugguuuguccccuccaucaagucuggaaaugauaucgccaacugucuucggaaaaauggcaagcgcgugauucagcugagcagaaagaccuucgacacggaguaucagaaaaccaagaacaacgacugggauuacguugugacaaccgacaucuccgaaaugggggcuaauuuccgggcggauagagucauugacccucgccggugccugaaacccgugauccucaaggauggcccggagagaguuauucuggccggaccuaugcccgugacagucgcuucugccgcccagcgccggggcagaaucgggcgcaaccagaauaaagagggagaccaguacguguauaugggccaaccccuuaacaaugaugaagaccacgcucauuggaccgaggccaagaugcugcucgauaacauuaauacaccugaagggaucauccccgcgcuguuugagccugaacgggaaaagagcgcugccauugacggagaguacagacugcgcggcgaagccagaaaaaccuucgucgagcucaugcggcgcggggaucuuccgguguggcuguccuauaagguugcuagcgaaggcuuucaguacucugacagacgguggugcuucgauggagagcgcaacaaucaggugcuggaagagaacauggacguggagaucuggacgaaagaaggcgagagaaagaaacuccggcccagauggcuggacgcccgcacauauuccgauccucuugcgcugcgggaauuuaaggaguucgccgcugggagacgcagcgucuccggagaccucauucuggaaaucggcaaacugccccagcaccucacccuucgggcccaaaaugcucuggauaaccugguuaugcuccacaauucugagcaagggggaaaggccuacagacaugcuauggaggaacugccugacaccauugagacacuuaugcugcucgcccugauggcggugcugaccggcggcgugacacucuuuuuccuuagcgggaagggacugggcaaaacguccaucgggcugcucugugucauggccucuagcgcucugcuuuggauggccuccguggaaccccacuggaucgcugccagcauuauccuggaguuuuuccucaugguucugcugauuccggagccugaucggcagcgcacaccccaggacaaccaacucgccuauguggucaucggacuucuguuuaugauucugacaguggcugcgaaugaaaugggccuccuggagaccacaaagaaagaucuugggaucggacaugucgccgcugaaaaccaccagcacgccaccaugcuggacguggaucuccauccugccucugcuuggacgcuguacgccguugcgaccacagugaucacccccaugaugagacacacaauugagaacaccacggccaauaucucccugacagcuauugccaaccaggcugccauccucaugggccuugacaagggcuggccuauuagcaaaauggaucugggggucccccugcucgcgcugggaugcuacucucaagugaauccgcuuacccugacagccgcuguucucaugcugguggcccauuaugcuaucauuggcccugggcugcaggccaaggcuacccgggaagcccagaagcgcaccgcggccggaaucaugaaaaaccccacagucgacggcaucguggcuauugaucucgaccccgugguuuacgacgccaaguucgagaaacagcuugggcaaaucaugcugcugauucucuguacgucccagauccugcuuaugagaaccacaugggcucugugcgagagcauuacccucgccacaggaccucugaccacgcugugggaaggcucuccgggcaaguuuuggaauacaaccaucgccgucagcauggcgaacaucuuccggggguccuaucucgcuggagccggccuugcuuucucucugaugaaaagccucgggggaggccgcagagggaccggagcccagggcgagacacucggcgaaaaguggaagcggcagcugaaucaacuuuccaaaagcgaguuuaacaccuacaagcgcuccgggauuauggaaguggauagaucugaggccaaagagggacugaagcggggcgaaacaacgaaacacgcugugagcagagggaccgccaagcuccgcugguucgucgagcggaaucugguuaagcccgaaggaaaagugaucgaccugggcugugggagaggaggcugguccuauuacugcgcgggccucaagaaagugacagaggucaagggguauaccaaaggaggcccugggcaugaagaacccauuccuauggccacauacggauggaaccuugugaagcugcacucuggcaaagaugucuuuuucaugcccccugagaagugugacacccugcucugcgauaucggggaaagcuccccgaaucccacgauugaggaaggacgcacccugcgggugcuuaagauggucgagccuuggcugagaggcaaccaguuuuguaucaaaauccucaaucccuacaugccuucugugguugagacacuggaacagaugcagcgcaagcacggcgggaugcuggugcggaacccccucagcagaaauuccacccaugagauguauugggucagcugcggaacaggcaacauugugucugcugugaauaugaccucccgcaugcugcuuaaccgguucacaauggcccacagaaaaccgaccuacgaacgcgacgucgaucugggggcuggaacgcggcauguugccguggagccugaaguggcgaaccucgacaucauuggccaaagaaucgagaauauuaagaacgagcacaaaagcacauggcacuaugaugaagacaaucccuacaagaccugggccuaucaugggucuuacgaggucaagcccuccggaagcgcuucuuccauggugaacggcguugugcgccugcuuaccaaaccuugggaugucauccccauggugacacagauugccaugacggacaccacaccuuuuggccagcaaagaguuuucaaggaaaaaguggacacccggacaccgcgcgcuaagagagggaccgcccagaucauggaggucacagcuaaauggcuguggggauuucucagccggaauaagaagcccagaaucuguacccgggaagaguucacgcgcaaagugagauccaacgccgcgauuggcgccguuuuuguggaugagaaucaguggaacagcgcuaaggaagccgucgaggacgaacgguucugggaucuggugcaccgcgagagagaacugcauaaacaggggaagugcgcuaccugcgucuauaauaugaugggaaaacgggagaagaagcucggcgaguuugggaaagccaagggcucucgcgccaucugguacauguggcugggagcgagauuccuugaguucgaggcucugggcuuuaugaacgaagaccacugguucagccgggaaaauucccucucugggguggagggagaaggccugcauaaacuuggguacauucugcgcgauaucagcaagauuccuggaggcaacauguaugccgacgauacagccgggugggacaccagaaucacagaggaugaccuccggaaugaagcuaaaaucaccgauauuauggagcccgaacacgcccugcuggcuacguccaucuuuaagcucacauaccaaaacaaaguugugcgcguccagagaccugccaagaauggcaccgugauggacgugauuucucggcgcgaucagagaggaagcggccagguugggacauauggacugaacaccuucacgaacauggaggugcaacuuauccggcagauggaguccgaaggcaucuuuuucucuagcgagcuggaaucccccaaucucgcggagagaguccuggacuggcuugaaaagcacggggccgagcgccugaaacggauggcuaucagcggagacgauugugugguuaagccgaucgacgauagauuugccaccgcucucauugcccugaacgacaugggcaaagugcgcaaggauaucccucagugggagcccucuaaaggguggaaugacuggcagcaagucccuuucugcucccaucacuuucaucagcugauuaugaaggauggccgggaaaucgugguccccuguagaaaccaggacgagcucgugggacgcgcgcggguuagccagggcgccggguggucucugagagaaacagcuugccuuggaaaguccuacgcccaaauguggcagcugauguauuuccaccgccgggaucucagacuggcugccaaugcuauuuguagcgccgugccugucgacugggugcccaccucccgcacaaccuggucuauccacgcgcaucaccaguggaugacaaccgaggauaugcuuagcguuuggaaccggguguggaucgaagagaauccguggauggaggacaaaacgcaugucuccagcugggaagaggugccuuaccugggcaagagagaagaccaauggugcgggucucucauuggacugacagcccgggcuaccugggccaccaacauccagguggccauuaaucagguuagacgccugaucggcaacgggaauuaucucgauuacaugacauccaugaaacgguuuaagaacgagagcgaccccgagggcgcucugugguga

SEQ ID NO: 18498 - RNA, 9879 nt, Artificial Sequence
  derived and/or modified CDS sequence (opt5) from DENV-1__FJ850075__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacgcuaauggcauccuugcccaggggaagaaaaugauucgcccgcaacccauggagcauaaguauagcuggaaguccuggggaaaagcuaagaucauuggcgccgauauccagaacaccaccuuuaucauugacgggccugauacacccgaauguccugacgaucagcgggccuggaauaucugggagguggaggacuacggauucggcauuuuuaccacgaacaucuggcucaaacugagagauucucacacacagaugugcgaccaccgccugaugagcgcugcgauuaaggauuccaaagccguccaugcugacaugggcuauuggaucgaaagcgagaagaaugaaaccuggaagcucgcccgggccucuuucaucgagguuaaaacauguauuuggcccaagucccacacccuguggagcaacggggugcuugaaucugagaugaucauuccgaaaaucuacggaggcccuauuucccaacauaauuauagacccggguacuucacacagaccgcuggaccuuggcaccugggcaagcucgagcuggauuuugaccugugcgaagggacgaccguggucguggaugagcacugcggauaccgcggccccagccuucggacaaccacaguuaccggcaaaacgauccaugaaugguguugcagaucuuguacacucccuccccugcgguuccgcggggaggacggaugcugguauggcauggagaucagaccggugaaggaaaaggaggaaaaccugguccggagcaugguguccgccgggagcggagagguugacucuuuuucccucggcauucugugugugagcauccuuauugaagaggucaugagaucccgcuggucucggaaaaugcugaugaccgggacacucgcgguguuccugcugcuuaucaugggacagcugaccuggaaugaucucauuagacugugcaucaugguuggcgcuaacgccagcgaccgcaugggcauggggaccacauaccucgcccugauggcuacguuuaagaugagaccuauguucgccgugggacuucuguuucggcgccucaccuccagagagguccugcugcuuacaauuggccugucucucguggcgagcguggaacugcccaauucccucgaggaacugggggauggacuugcuaugggcaucaugaugcugaaacuccugaccgacuuccaaccccaccagcuguggacaacccuucugucucucacguuuauccggacaagccugucccucgauuaugccuggaagaccauggccauggcucugagcauugucucucuuuucccucugugucuguccaccacaagccagaaaaccacauggcucccgguucugcuugggucuuuuggaugcaagccccugacgauguuccucaucaccgagaacaagauuuggggccgcaaauccuggccuaucaacgaaggcauuauggccguggggaucgugagcauccugcucucuucccugcuuaagaaugacgucccccuggcuggaccucugauugccggcgggaugcucaucgcguguuacgugauuagcggauccagcgccgaucugucucuugagaaagcugccgagguuagcugggaagaggaagcugagcauuccggcacaucucacaacauccugguggaaguccaggacgaugggaccaugaagauuaaagacgaggagagagaugacacacucaccauccugcucaaggccacgcugcuugccgugagcggaguuuaucccauguccaucccugcuacccuguuugugugguacuucuggcaaaaaaagaagcagcggucuggcguccugugggauacacccagcccgccugaaguggagcgcgcgguccucgacgacggcauuuauagaauccugcagcgggggcuucugggacgcucccaggugggcguugggguguuccaagauggagucuuucauaccauguggcacgugacaagaggcgccguucucauguaccaggggaaacggcuggaacccucuugggcuagcgugaagaaagaccucauuuccuacggaggcggcuggagauuccaggggagcuggaauaccggagaggagguccaggugaucgccguggaaccuggcaagaaccccaaaaauguucaaacaacgccggggaccuuuaagacaccugagggagaagucggcgccauugcucuggauuucaagcccgggaccucuggauccccuaucgugaaccgcgagggcaaaauugugggccuuuaugggaauggagucgugaccacaagcggcacguacguuucugccaucgcgcaggcuaaggccucccaggaagggccccugcccgagaucgaggacgaaguguuuaaaaagcggaaccugaccauuauggaucuccacccuggaagcggcaaaacaagacgcuaucugccggccaucguccgggaggcuauuaagagaaagcuucgcacccugauccucgcccccacacgggugguugcguccgaaauggcugaggcccugaaagggaugccuauuagauaccaaaccacggccgugaagucugaacauacaggccgcgagaucgucgaccugaugugccacgcuaccuucaccaugcggcuccuuagccccgugagaguuccuaauuauaacaugaucauuauggaugaggcccauuuuacagaccccgcuuccaucgccgcgcggggauacauuagcacccgcgugggcaugggggaagccgcugccaucuucaugacagcuaccccuccgggaucugucgaggccuuuccccaguccaaugccgugauucaggaugaagagagagacaucccugaacggagcuggaacucuggcuaugauuggaucacggacuuccccgggaaaacagugugguuugucccuagcauuaaguccggaaaugacaucgcuaacugucugcgcaaaaauggcaagagaguuauucagcugucucggaagaccuucgauacagaguaccaaaaaaccaagaacaacgacugggauuacguggugacgaccgacaucagcgagaugggggcgaauuucagagccgaucgcgucauugacccccggagaugccucaaaccggugauccugaaggauggcccugaacgcguuauucuugcuggacccaugcccgugacagucgccuccgccgcucagcggagaggccgcaucgggcggaaccagaauaaagagggagaccaguauaucuacaugggccaaccucugaacaaugaugaagaccacgcccauuggaccgaggcgaagaugcuccuggauaacauuaauacacccgaggggaucauuccugcucuguuugaaccggagagagaaaagucugccgccaucgacggagaguaucgccucagaggcgaagcucggaaaaccuucguggagcuuaugcgcagaggggaucugcccguuuggcugagcuacaagguggccuccgagggcuuucaguauagcgaccggcgcuggugcuucgacggagaaagaaacaaucagguccucgaggaaaacauggauguggagauuuggacaaaagaaggcgagcggaagaaacugagaccucgcuggcuugacgcgcggaccuacucugauccccuggcccucagagaguuuaaggaauucgcugccgggcgccgguccgucagcggagaccugauccuggagaucggcaaacucccucagcaccuuacgcugagagcucaaaaugcccuggauaaccucgugaugcugcacaauuccgaacaggggggaaaggcuuaucggcaugccauggaggaacuucccgacacaauugagacccugaugcuccuggcgcugaucgccguucucaccggcggcgugacacuuuuuuuccugucugggaagggacugggcaaaaccagcauugggcuccugugugugauggcuuccucugcccuucuguggauggcuagcgucgagccgcacuggaucgccgccuccauuauccucgaauuuuuccugaugguucugcucaucccugagcccgaucgccagagaacaccucaggacaaccaacuugcuuacguggugauuggacugcuguuuaugauccucacggucgcggccaaugaaaugggccugcuugagaccacaaagaaagaucuggggauuggacauguggcugccgagaaccaccaccaugccaccaugcucgacguugaucugcggcccgcuagcgccuggacacuguacgcgguggccaccacggucaucaccccuaugaugcgccacacaauugaaaacaccacagcuaauaucucucucaccgccauugcuaaccaggccgcgauccuuaugggccuggacaagggcuggcccaucuccaaaauggauauuggggugccgcugcucgcccugggaugcuauagccaggucaauccucuuacgcugacagcugccgugcucaugcugguugcucauuacgccaucauuggccccgggcugcaagcuaaggccaccagagaggcgcagaagcggacagccgcuggaaucaugaaaaaccccaccguggacggcauugucaccaucgaccucgauccugugguuuaugacgccaaguucgaaaaacagcuugggcagaucaugcugcugauucucuguacaucucaaauccugcuuaugcgcacgaccugggcucugugcgaguccauuacacucgccaccggaccgcugacaacccugugggaaggcagccccggcaaguuuuggaauacgacaaucgccgugucuauggcgaacauuuucagagggagcuaccucgcuggagccggccuugcuuucucccugaugaaaucucuggggggaggccggcgcgggaccggagcccagggcgagacccucggcgagaaguggaagagacagcugaaucagcuuagcaaauccgaauuuaacacauauaagaaaagcgggaucauggaggucgaucgguccgaagccaaggagggacugaaaagaggcgaaaccacaaagcacgcugugucucgcgggacggccaagcuccggugguucguggagagaaaucugguuaaaccugagggaaaggucaucgaccugggcugugggcgcggaggcuggagcuacuauugcgcgggccucaaaaaggugaccgaagugaaaggguacacaaagggaggccccgggcaugaggaaccuauucccauggccaccuacggauggaaccuugucaaacugcacuccggcaaggauguuuuuuucacaccuccggagaagugugacacccugcucugcgauaucggggaaucuagccccaauccuacgauugaggagggacggacccugagagugcuuaaaaugguggaacccuggcugcgcggcaaccaauuuuguaucaagauucucaauccuuauaugcccuccgucguggagacacuggaacagaugcagcggaaacacggcgggaugcugguuagaaacccgcucucucgcaauagcacccaugagauguacuggguguccugcggaacaggcaacaucgucagcgcugugaauaugaccucucggaugcugcuuaacagauucacaauggcccaccgcaagccuaccuaugagcgggacguugaucugggggcuggaacgagacauguggccgucgaacccgagguggcgaaccucgacauuaucggccagcgcaucgaaaauauuaaaaacgagcacaaguccacauggcacuacgaugaagacaaucccuauaagaccugggccuaccaugggagcuaugaggugaaaccuucuggauccgcuagcucuauggucaacggcguugugagacugcuuaccaagcccugggacgugaucccuauggucacacaaauugccaugacggauaccacaccguuuggccagcagcggguguucaaagagaagguugacacccgcacacccagagcuaaacgggggaccgcccaaaucauggaagugacagcuaaguggcuguggggauuucucuccagaaauaagaaaccucggauuuguacccgcgaggaauucacgagaaagguccggagcaacgccgcgaucggcgccguguuuguugaugagaaucaguggaacuccgcuaaagaagccguggaggacgagcgcuucugggaucugguccacagagaacgggagcugcauaagcaggggaaaugcgcuaccugcguguacaauaugaugggaaagcgcgaaaagaaacucggcgaguuugggaaggccaaaggcagcagagccaucugguacauguggcugggagcgcgguuccuugaauucgaggcucugggcuuuaugaacgaggaccacugguucucucgcgaaaauagccucuccgggguugagggagaaggccugcauaagcuuggguauauucugagagauaucucuaaaauucccggaggcaacauguacgccgacgauacagccgggugggacacccggaucacagaggaugaccuccagaaugaggcuaagauuaccgauaucauggaaccugagcacgcccugcuggcuacgagcaucuuuaaacucacauaucaaaacaaggugguccgcgugcagagacccgccaaguccggcaccgucauggacgugauuucucggcgcgaccagagaggaagcggccagguugggacauacggacugaauaccuucacgaacauggaagugcaacuuauccggcagauggaguccgaaggcauuuuuucuccgagcgagcuggagaccccuaaccucgcgaaaagaguccuggauuggcuugaaaagcacgggguggagcgccugaaacggauggccaucuccggagacgauugugugguuaagcccauugacgauagauucgcuacagcccucaccgcucugaaugacaugggcaaagugcgcaaggauaucccucagugggaacccagcaagggguggaacgacuggcagcaagucccuuuuugcucucaucacuuccaucagcugaucaugaaagauggccgggagauugugguucccuguagaaaucaggacgaacucgugggacgcgcccgggucucccagggcgcgggguggagccugagagagacagccugccuuggaaagucuuaugcucaaauguggcagcugauguacuuucaccgccgggaucucagacuggccgcuaacgccaucuguuccgcugugccggucgacugggugccuaccagccgcacaaccugguccauucacgcccaucaccaguggaugacgacagaggacaugcuuucuguuuggaaucggguguggaucgaagagaaccccuggauggaagauaaaacccaugucagcuccugggaggaagugcccuaucugggcaagagagaggaccaauggugcgggagccucauuggacugaccgcgcgggccacaugggcuaccaauauccagguugccauuaaccaggugagacgccugaucggcaaugagaacuaccucgauuacaugacaucuaugaaacgguucaagaaugaauccgacccugagggggcccugugguga

SEQ ID NO: 18499 - RNA, 9879 nt, Artificial Sequence
  derived and/or modified CDS sequence (opt5) from DENV-1__FJ850077__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagagguggaacccgacgaugucgacuguuggugcaaugcgaccgauacgugggugaccuauggaacauguucccaaaccggcgagcacagacgggacaagcgcucuguugcucuggccccucauguggggcucggacuggagacaagaaccgaaacguggaugagcuccgagggcgccuggaaacagguccagaagguggaaacaugggcucuucggcaccccggcuucaccguuauugcccuguuucucgcucaugccaucgggacaucuauuacccagaagggaaucaucuucauucugcuuaugcuggugaccccuagcauggcgaugcgcugcgucggcaucgggaacagagauuuuguggagggacucuccggcgccacauggguggacgucguucuggagcacgggagcugugugacgaccauggcuaaaaauaagcccacacuggauauugaacuccugaaaaccgaggugacaaacccugccguccuucggaagcugugcaucgaagcuaaaauuucuaauaccacgacagacucccgcuguccgacccaaggagaggccacccucguggaagagcaggaugcgaacuucguuugcagacggacauuuguggaccgcggcuggggcaauggguguggacuguucggcaaggggagccuucugaccugcgccaaguuuaaaugcgucacaaagcucgagggaaaaaucgugcaguacgaaaaccugaaguauucuguuauugugacgguccacaccggcgaucagcaucaaguggggaaugagacaaccgaacacggaacaaucgcuaccaucacgccccaggccccuaccuccgagauucagcugacagacuacggcgcucucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcugguuacauucaagaccgcccacgcuaagaaacaggaaguggucgugcucggaucucaagagggcgcgaugcacaccgcccugacaggggcuacggaaauccagaccagcggaacaaccacaauuuuugccggccaucuuaagugccgccugaaaauggacaagcucacccugaaagggauguccuauguuauguguacgggcagcuucaagcuggagaaggaaguggccgagacacagcacggaaccguccuugugcaggugaaauacgagggcaccgaugcuccgugcaagaucccuuuccucacacaagacgaaaaagggguuacccagaacggaagacugauuacagccaaucccaucgucacggauaaggagaaaccugugaacaucgaaaccgagccccccuuuggcgagucuuauauuguggucggggcgggagaaaaggcucugaagcucuccugguucaaaaagggcagcucuaucgggaaaauguuugaggccacagcccggggcgcuagacgcauggccauucugggagacaccgcuugggauuucggcagcaucgggggacuuuuuacauccgugggcaagcugauucaucagguuuucgggaccgccuacggagugcucuuuucuggcgucagcuggacgaugaaaaucgggaucggcauucugcugaccuggcuuggacucaauucccggagcacaucucuguccaugaccuguaucgcggugggcaugguuacacuguaccucggggugaugguccaggccgacagcggaugcgugauuaacuggaagggcagagaacugaagugugggucuggaaucuucguuaccaacgaggugcacacauggaccgaacaauauaaauuucaggcugauuccccuaagcgccuuagcgccgcuauuggcaaagccugggaggagggggucugcggcauccgguccgcgacgagacuggaaaauauuauguggaagcagaucucuaacgagcucaauuacauccugcuggaaaacgacaugaaauucacagugguggucggagacgccaauggcauucuuacccaggggaagaaaaugauccgcccgcaacccauggagcauaaguauagcuggaaguccuggggaaaagcuaagauuaucggcgccgauauucagaacaccacauuuaucaucgacgggccugauacccccgaauguccugacgaucagcgggcuuggaauauuugggagguugaggacuacggauucggcaucuuuacgacaaacauuuggcucaaacugagagauucuuauacccagaugugcgaccaccgccugaugagcgccgccaucaaggauuccaaagcugugcacgcggacaugggcuacuggauugaaagcgagaagaaugaaacauggaagcucgcccgggcuucuuucaucgaggugaaaaccuguaucuggcccaagucccauacacuguggagcaacgggguccuugaaucugagaugauuaucccgaaaauuuauggaggcccuaccucccaacacaauuacagacccggguacuucacgcagaccgccggaccuuggcaucugggcaagcucgagcuggauuuugaccugugcgaagggacaaccgugguuguggaugagcacugcggauaucgcggccccagccuucggacaaccacggucacaggcaaaaucauucacgaaugguguugcagaucuuguacccucccuccccugcgguuccgcggggaggacggaugcugguacggcauggagaucagaccggugaaggaaaaggaggaaaaccugguucggagcaugguguccgccgggagcggagaggucgacucuuuuucccucggcauccugugugugagcauucuuaucgaagagguuaugagaucccgcuggucucggaaaaugcugaugacagggacccucgcuguguuccugcugcuuauuaugggacagcugaccuggaaugaucucaucagacugugcauuauggucggcgccaacgcgagcgaccgcaugggcauggggacaacguaucucgcucugauggccaccuuuaagaugagaccuauguucgccgugggacuucuguuucggaaacucacaucccgcgaggugcugcugcuuaccaucggccugucucucgucgcuagcguugaacugcccaauucccucgaggaacugggggauggacuugccaugggcauuaugaugcugaagcuccugacagacuuccaaccccaucagcuguggaccacgcuucugucucucacauuuaucagaaccagccugucccucgauuacgcguggaaaaccauggcuauggcccugagcaucgugucucuuuucccucugugucuguccacaaccagccagaagacaacguggcucccggugcugcuugggucuuuuggaugcaagccccugaccauguuccucauuacagagaaccggaucuggggccgcaaauccuggccuauuaacgaaggcgucauggccguggggaucguuagcauucugcucucuucccugcuuaagaaugacgugccccuggcuggaccucugaucgccggcgggaugcucaucgcuuguuaugucauuagcggauccagcgccgaucugucucuugagaaagcggccgaggugagcugggaagaggaagcugagcacuccggcaccucucauaacauccugguugaagugcaggacgaugggacaaugaagauuaaagacgaggagagagaugacacccucacgauccugcucaaggccacccugcuugcugucagcggaguguaccccauguccauuccugccacacuguuugucugguauuucuggcaaaaaaagaagcagcggucuggcgugcugugggauacccccagcccgccugaaguugagcgcgccgugcucgacgacggcaucuacagaauccugcagcgggggcuucugggacgcucccaggucggcguggggguuuuccaagauggaguguuucacacaauguggcaugucaccagaggcgcugugcucauguaccaggggaaacggcuggaacccucuugggcgagcgugaagaaagaccucauuuccuauggaggcggcuggagauuccaggggagcuggaauacaggagaggagguucaggucaucgccguggaaccuggcaagaaccccaaaaaugugcaaacgaccccggggacauuuaagaccccugagggagaagucggcgcuauugcccuggauuucaagcccgggaccucuggauccccuaucgugaaccgcgagggcaaaauuguuggccuuuacgggaauggaguggucacaacgagcggcaccuaugugucugccaucgcucaggccaaggcgucccaggaagggccccugcccgagauugaggacgaaguuuuuaaaaagcggaaccugacaaucauggaucuccacccuggaagcggcaaaaccagacgcuaccugccggcuaucgugcgggaggccauuaagagaaagcuucgcacacugauccucgcccccacccgggucguggcuuccgaaauggccgaggcgcugaaagggaugccuauuagauaucaaacgacagcuguuaagucugaacacaccggccgcgagaucguggaccugaugugccaugccaccuucacaaugcggcuccuuagccccgucagagugccuaauuacaacaugauuaucauggaugaggcccacuuuaccgaccccgcuuccaucgccgcucggggauauauuagcacacgcgugggcaugggggaagccgcggccaucuucaugaccgcuacgccuccgggaucugucgaggccuuuccccaguccaaugcuguuauucaggaugaagagagagacaucccugaacggagcuggaacucuggcuacgauuggauuacagacuuccccgggaaaaccgugugguuugugccuagcaucaaguccggaaaugacaucgccaacugucugcgcaaaaauggcaagagagucauucagcugucucggaagacauucgauaccgaguaccaaaaaacgaagaacaacgacugggauuaugugguuaccacagacaucagcgagaugggggccaauuucagagcugaucgcgugauugacccccggagaugccucaaaccggucauccugaaggauggcccugaacgcgugauucuugcgggacccaugcccguuaccguggccuccgcugcccagcggagaggccgcaucgggcggaaccagaauaaagagggagaccaguacauuuauaugggccaaccucugaacaaugaugaagaccaugcccacuggacagaggcuaagaugcuccuggauaacaucaauacccccgaggggaucauuccugcccuguuugaaccggagagagaaaagucugcggcuaucgacggagaguaccgccucagaggcgaagcccggaaaacauucgucgagcuuaugcgcagaggggaucugcccguguggcugagcuauaaggucgccuccgagggcuuucaguacagcgaccggcgcuggugcuucgacggagaaagaaacaaucaggugcucgaggaaaacauggauguugagauuuggaccaaagaaggcgagcggaagaaacugagaccucgcuggcuugacgcucggacguauucugauccccuggcccucagagaguuuaaggaauucgcggccgggcgccgguccgugagcggagaccugauccuggagauuggcaaacucccucagcaucuuacacugagagcucaaaaugcccuggauaaccucgugaugcugcacaauuccgaacaggggggaaaggcuuaccggcacgccauggaggaacuucccgacaccaucgagacccugaugcuccuggcucugaucgccguccucacaggcggcguuacccuuuuuuuccugucugggaagggacugggcaaaacaagcauugggcuccugugugugauggcguccucugcccuucuguggauggcuagcguggagccgcauuggaucgccgcuuccauuauccucgaauuuuuccugaugguccugcucauuccugagcccgaucgccagagaacgccucaggacaaccaacuugccuacgugguuaucggacugcuguuuaugauccucaccguggccgcuaaugaaaugggccugcuugagacaaccaagaaagaucuggggauuggacacgucgcggccgagaaccaucaccacgcuacaaugcucgacguggaucugcggcccgccagcgccuggacccuguaugcugucgccacgaccgugaucacaccuaugaugcgccauaccauugaaaacacaaccgcgaauaucucucucacggccauugcuaaccaggccgcuauccuuaugggccuggacaagggcuggcccauuuccaaaauggauaucgggguuccgcugcucgcccugggaugcuacagccaggugaauccucuuacacugaccgcgacaguccucaugcugguggcccacuaugcuaucauuggccccgggcugcaagccaaggcuaccagagaggcccagaagcggaccgcugccggaaucaugaaaaaccccacaguugacggcauugugacgaucgaccucgauccugucguguacgacgcgaaguucgaaaaacagcuugggcagauuaugcugcugauccucuguaccucucaaauccugcuuaugcgcacaaccugggcccugugcgaguccauuacacucgcuaccggaccgcugacgacacugugggaaggcagccccggcaaguuuuggaauaccaccaucgccgugucuauggcuaacauuuucagagggagcuaucucgccggagccggccuugcguucucccugaugaaaucucuggggggaggccggcgcgggacaggagcucagggcgagacccucggcgagaaguggaagagacagcugaaucagcuuagcaaauccgaauuuaacacauacaagaaaagcgggaucauggagguugaucgguccgaagccaaggagggacugaaaagaggcgaaacgaccaagcaugcugucucucgcgggacagccaagcuccggugguucguggagagaaaucuggugaaaccugagggaaaggucauugaccugggcugugggcgcggaggcuggagcuauuacugcgccggccucaaaaagguuaccgaagugaaaggguacacaaagggaggccccgggcacgaggaaccuauccccauggcuaccuauggauggaaccuugugaaacugcauuccggcaaggaugucuuuuucacgccuccggagaagugugacacccugcucugcgauaucggggaaucuagccccaauccuacaauugaggagggacggacccugagagugcuuaaaaugguugaacccuggcugcgcggcaaccaauuuuguaucaagauucucaauccuuacaugcccuccguggucgagacacuggaacagaugcagcggaaacacggcgggaugcuggugagaaacccgcucucucgcaauagcacccacgagauguauuggguuuccugcggaacaggcaacaucgugagcgccgucaauaugaccucucggaugcugcuuaacagauucacgauggcgcaucgcaagccuacauacgagcgggacguggaucugggggccggaaccagacacguggcugucgaacccgagguugccaaccucgacauuaucggccagcgcauugaaaauaucaaaaacgagcauaaguccaccuggcacuaugaugaagacaaucccuacaagacaugggcuuaucacgggagcuacgaggugaaaccuucuggauccgccagcucuauggugaacggcgucgugagacugcuuacgaagcccugggacguuaucccuauggugacccaaauugcgaugacagauaccacaccguuuggccagcagcgggucuucaaagagaagguggacacccgcacacccagagccaaacgggggaccgcucaaaucauggaaguuacggccaaguggcuguggggauuucucuccagaaauaagaaaccucggauuuguacccgcgaggaauucacaagaaaggugcggagcaacgcugccaucggcgcugucuuuguggaugagaaucaguggaacuccgccaaagaagcgguugaggacgagcgcuucugggaucuggugcauagagaacgggagcugcacaagcaggggaaaugcgccaccugcgucuacaauaugaugggaaagcgcgaaaagaaacucggcgaguuugggaaggcuaaaggcagcagagccauuugguauauguggcugggagcucgguuccuugaauucgaggcccugggcuuuaugaacgaggaccauugguucucucgcgaaaauagccucuccgggguggagggagaaggccugcacaagcuuggguacauccugagagauaucucuaaaauucccggaggcaacauguaugccgacgauacagcggggugggacacccggaucacggaggaugaccuccagaaugaggcuaagauuacagauaucauggaaccugagcaugcccugcuggccaccagcauuuuuaaacucacauaccaaaacaaggucgugcgcguucagagacccgcuaaguccggcaccgugauggacgucaucucucggcgcgaccagagaggaagcggccagguggggacguauggacugaauaccuucacaaacauggaagugcaacuuauccggcagauggaguccgaaggcauuuuuucuccgagcgagcuggagaccccuaaccucgccaaaagaguucuggauuggcuugaaaagcacggggcugagcgccugaaacggauggccaucuccggagacgauuguguggucaagcccauugacgauagauucgcgacagcccucaccgcucugaaugacaugggcaaagugcgcaaggauaucccucagugggaacccagcaagggguggaacgacuggcagcaaguuccuuuuugcucucaccauuuccaccagcugauuaugaaagauggccgggacaucgugguccccuguagaaaucaggaugagcucgugggacgcgcccgggucucccagggcgcuggguggagccugagagaaacagccugccuuggaaagucuuacgcgcaaauguggcagcugauguauuuucaucgccgggaccucagacuggccgcuaacgccaucuguuccgcugugccgguugacugggugccuaccagccgcacgacaugguccauucacgcccaccaucaguggaugaccaccgaggauaugcuuucugucuggaaucggguguggaucgaggaaaaccccuggauggaggacaaaacacacguuagcuccugggaagaggugcccuaccugggcaagagagaagaucaauggugcgggagccucauuggacugaccgcucgggccacaugggcgacgaauauccaggucgccauuaaccaggugagacgccugaucggcaaugagaacuaccucgacuauaugaccucuaugaaacgguucaagaaugaguccgauccugaaggggcucugugguga

SEQ ID NO: 18500 - RNA, 9879 nt, Artificial Sequence
  derived and/or modified CDS sequence (opt5) from DENV-1__FJ850081__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacgcuaauggcauccuugcccaggggaagaaaaugauucgcccgcaacccauggagcauaaguauagcuggaaguccuggggaaaagcuaagaucauuggcgccgauauccagaacaccaccuuuaucauugacgggccugauacacccgaauguccugacgaucagcgggccuggaauaucugggagguggaggacuacggauucggcauuuuuaccacgaacaucuggcucaaacugagagauucucacacacagaugugcgaccaccgccugaugagcgcugcgauuaaggauuccaaagccguccaugcugacaugggcuauuggaucgaaagcgagaagaaugaaaccuggaagcucgcccgggccucuuucaucgagguuaaaacauguauuuggcccaagucccacacccuguggagcaacggggugcuugaaucugagaugaucauuccgaaaaucuacggaggcccuauuucccaacauaauuauagacccggguacuucacacagaccgcuggaccuuggcaccugggcaagcucgagcuggauuuugaccugugcgaagggacgaccguggucguggaugagcacugcggauaccgcggccccagccuucggacaaccacaguuaccggcaaaaucauccaugaaugguguugcagaucuuguacgcucccuccccugcgguuccgcggggaggacggaugcugguauggcauggagauuagaccggugaaggaaaaggaggaaaaccugguccggagcaugguguccgccgggagcggagagguugacucuuuuucccucggcauccugugugugagcauucuuaucgaagaggucaugagaucccgcuggucucggaaaaugcugaugacagggacccucgcgguguuccugcugcuuauuaugggacagcugacauggaaugaucucaucagacugugcauuaugguuggcgcuaacgccagcgaccgcaugggcauggggaccaccuaccucgcccugauggcuacauuuaagaugagaccuauguucgccgugggacuucuguuucggcgccucacguccagagagguccugcugcuuaccaucggccugucucucguggcgagcguggaacugcccaauucccucgaggaacugggggauggacuugcuaugggcaucaugaugcugaaacuccugacagacuuccaaccccaccagcuguggaccacacuucugucucucaccuuuauucggacgagccugucccucgauuaugccuggaagacaauggccauggcucugagcaucgucucucuuuucccucugugucuguccaccaccagccagaaaacaaccuggcucccgguucugcuugggucuuuuggaugcaagccccugacaauguuccucauuacggagaacaagaucuggggccgcaaauccuggccuauuaacgaaggcaucauggccguggggaucgugagcauucugcucucuucccugcuuaagaaugacgucccccuggcuggaccucugaucgccggcgggaugcucauugcguguuacgugaucagcggauccagcgccgaucugucucuugagaaagcugccgagguuagcugggaagaggaagcugagcauuccggcaccucucacaacauucugguggaaguccaggacgaugggacaaugaagaucaaagacgaggagagagaugacacccucacaauccugcucaaggccacccugcuugccgugagcggaguuuaucccauguccauuccugcuacgcuguuugugugguacuucuggcaaaaaaagaagcagcggucuggcguccugugggauacccccagcccgccugaaguggagcgcgcgguccucgacgacggcaucuauagaauucugcagcgggggcuucugggacgcucccaggugggcguugggguguuccaagauggagucuuucauacaauguggcacgugaccagaggcgccguucucauguaccaggggaaacggcuggaacccucuugggcuagcgugaagaaagaccucaucuccuacggaggcggcuggagauuccaggggagcuggaauacaggagaggagguccaggugauugccguggaaccuggcaagaaccccaaaaauguucaaaccacaccggggacguuuaagaccccugagggagaagucggcgccaucgcucuggauuucaagcccgggacaucuggauccccuauugugaaccgcgagggcaaaaucgugggccuuuaugggaauggagucgugaccaccagcggcacauacguuucugccaucgcgcaggcuaaggccucccaggaagggccccugcccgagauugaggacgaaguguuuaaaaagcggaaccugacgaucauggaucuccacccuggaagcggcaaaaccagacgcuaucugccggccauuguccgggaggcuaucaagagaaagcuucgcacacugauucucgcccccacccgggugguugcguccgaaauggcugaggcccugaaagggaugccuaucagauaccaaacaaccgccgugaagucugaacauacgggccgcgagaucgucgaccugaugugccacgcuacauucaccaugcggcuccuuagccccgugagaguuccuaauuauaacaugauuaucauggaugaggcccauuuuaccgaccccgcuuccauugccgcgcggggauacaucagcacacgcgugggcaugggggaagccgcugccauuuucaugaccgcuacaccuccgggaucugccgaggccuuuccccaguccaaugcugucauccaggaugaagagagagacaucccugaacggagcuggaacucuggcuaugauuggauuaccgacuuccccgggaaaacggugugguuugugccuagcaucaaguccggaaaugacauugcgaacugucugcgcaaaaauggcaagagagucauccagcugucucggaagacauucgauaccgaguaccaaaaaacaaagaacaacgacugggauuacguugugaccacggacauuagcgagaugggggccaauuucagagcugaucgcgugaucgacccccggagaugccucaaaccggucauucugaaggauggcccugaacgcgugauccuugccggacccaugcccguuaccguggccuccgcugcccagcggagaggccgcaucgggcggaaccagaauaaagagggagaccaguauauuuacaugggccaaccucugaacaaugaugaagaccacgcgcauuggacagaggcuaagaugcuccuggauaacaucaauacccccgaggggauuaucccugcccuguuugaaccggagagagaaaagucugccgcuauugacggagaguaucgccucagaggcgaagcccggaaaacauucgucgagcuuaugcgcagaggggaucugcccguguggcugagcuacaagguugcguccgagggcuuucaguauagcgaccggcgcuggugcuucgacggagaaagaaacaaucaggugcucgaggaaaacauggaugucgagaucuggaccaaagaaggcgagcggaagaaacugagaccucgcuggcuugacgcccggacauacucugauccccuggcucucagagaguuuaaggaauucgccgcugggcgccgguccgugagcggagaccugauccuggagauuggcaaacucccucagcaccuuacccugagagcccaaaaugcucuggauaaccucgucaugcugcacaauuccgaacaggggggaaaggccuaucggcaugcgauggaggaacuucccgacacgaucgagacacugaugcuccuggcccugauugcugugcucaccggcggcguuacccuuuuuuuccugucugggaagggacugggcaaaacaagcaucgggcuccugugugugauggccuccucugcucuucuguggauggccagcguggagccgcacuggauugccgcuuccaucauccucgaauuuuuccugaugguccugcucauuccugagcccgaucgccagagaaccccucaggacaaccaacuugcguacguugugaucggacugcuguuuaugauucucacaguggccgcuaaugaaaugggccugcuugagacgaccaagaaagaucuggggaucggacaugucgccgccgagaaccaccaccaugcuacaaugcucgacguggaucugcggcccgccagcgcguggacccuguacgccguugcuacaaccgugauuacgccuaugaugcgccacaccaucgaaaacacaaccgccaauauuucucucacagcuaucgccaaccaggcggccauccuuaugggccuggacaagggcuggcccauuuccaaaauggauaucggggucccgcugcucgcucugggaugcuauagccaggugaauccucuuacccugacggccgcuguccucaugcugguggcccauuacgcuauuaucggccccgggcugcaagccaaggcgacaagagaggcccagaagcggaccgcugccggaauuaugaaaaaccccacaguugacggcaucgugaccaucgaccucgauccugucguguaugacgcuaaguucgaaaaacagcuugggcagauuaugcugcugauccucuguaccucucaaauucugcuuaugcgcacaacgugggcccugugcgaguccaucacccucgccacaggaccgcugaccacacugugggaaggcagccccggcaaguuuuggaauaccacgauugcgguuucuauggcuaacaucuucagagggagcuaccucgccggagcuggccuugccuucucccugaugaaaucucuggggggaggccggcgcgggacaggagcccagggcgagacccucggcgagaaguggaagagacagcugaaucagcuuagcaaauccgaauuuaacaccuauaagaaaagcgggaucauggagguggaucgguccgaagcuaaggagggacugaaaagaggcgaaacaaccaagcacgccgucucucgcgggacagcgaagcuccggugguucguggagagaaaucuggugaaaccugagggaaagguuauugaccugggcugugggcgcggaggcuggagcuacuauugcgccggccucaaaaaggucacggaagugaaaggguacaccaagggaggccccgggcaugaggaaccuauccccauggcuacauacggauggaaccuugugaaacugcacuccggcaaggaugucuuuuucaccccuccggagaagugugacacacugcucugcgauauuggggaaucuagccccaauccuaccaucgaggagggacggacgcugagaguucuuaaaaugguggaacccuggcugcgcggcaaccaauuuuguauuaagauccucaauccuuauaugcccuccguggucgagacccuggaacagaugcagcggaaacacggcgggaugcuggugagaaacccgcucucucgcaauagcacacaugagauguacuggguuuccugcggaaccggcaacauugugagcgccgucaauaugacaucucggaugcugcuuaacagauucaccauggcucaccgcaagccuacauaugagcgggacguggaucugggggccggaaccagacauguugcgguggaacccgaggucgccaaccucgacaucaucggccagcgcauugaaaauaucaaaaacgagcacaaguccacguggcacuacgaugaagacaaucccuauaagacaugggcuuaccaugggagcuaugaggugaaaccuucuggauccgccagcucuauggugaacggcgucguuagacugcuuaccaagcccugggacgugauuccuauggugacccaaaucgcuaugacagauacgaccccguuuggccagcagcgggucuucaaagagaagguggacacacgcacccccagagccaaacgggggacagcucaaauuauggaaguuaccgccaaguggcuguggggauuucucuccagaaauaagaaaccucggaucuguacacgcgaggaauucaccagaaaggugcggagcaacgcggccaucggcgcugucuuuguggaugagaaucaguggaacuccgccaaagaagcuguugaggacgagcgcuucugggaucuggugcacagagaacgggagcugcauaagcaggggaaaugcgccacgugcgucuacaauaugaugggaaagcgcgaaaagaaacucggcgaguuugggaaggccaaaggcagcagagcgauuugguacauguggcugggagcucgguuccuugaauucgaggcccugggcuuuaugaacgaggaccacugguucucucgcgaaaauagccucuccgggguggagggagaaggccugcauaagcuuggguauauccugagagauauuucuaaaauccccggaggcaacauguacgccgacgauaccgcugggugggacacacggauuaccgaggaugaccuccagaaugaggccaagaucacagauaucauggaaccugagcacgcucugcuggccaccagcauuuuuaaacucacguaucaaaacaagguugugcgcguccagagacccgcgaaguccggcacagugauggacgucaucucucggcgcgaccagagaggaagcggccagguggggaccuacggacugaauacauucaccaacauggaaguucaacuuauucggcagauggaguccgaaggcaucuuuucuccgagcgagcuggagacgccuaaccucgccaaaagagugcuggauuggcuugaaaagcacggggcugagcgccugaaacggauggccauuuccggagacgauugugucgugaagcccaucgacgauagauucgcuaccgcccucacagcgcugaaugacaugggcaaagugcgcaaggauaucccucagugggaacccagcaagggguggaacgacuggcagcaaguuccuuuuugcucucaucacuuccaucagcugauuaugaaagauggccgggagaucgugguccccuguagaaaucaggacgaacucgugggacgcgcccggguuucccagggcgcuggguggagccugagagagaccgccugccuuggaaagucuuaugcucaaauguggcagcugauguacuuucaccgccgggaucucagacuggccgcuaacgccauuuguuccgcggugccggucgacugggugccuacaagccgcaccacaugguccauccacgcccaucaccaguggaugaccacggaggacaugcuuucugucuggaaucggguguggauugaagagaaccccuggauggaagauaaaacacauguuagcuccugggaggaagugcccuaucugggcaagagagaggaccaauggugcgggagccucaucggacugaccgcucgggccaccugggccacaaauauucaggucgcuaucaaccaggugagacgccugaucggcaaugagaacuaccucgauuacaugaccucuaugaaacgguucaagaaugaauccgacccugagggggcccugugguga

SEQ ID NO: 18501 - RNA, 9879 nt, Artificial Sequence
  derived and/or modified CDS sequence (opt5) from DENV-1__FJ850084__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagagguggaacccgacgaugucgacuguuggugcaaugcgaccgauacgugggugaccuauggaacauguucccaaaccggcgagcacagacgggacaagcgcucuguugcucuggccccucauguggggcucggacuggagacaagaaccgaaacguggaugagcuccgagggcgccuggaaacagauucagaaggucgaaacaugggcucuucggcaccccggcuucaccgugaucgcccuguuucucgcucaugccauugggacaucuaucacccagaagggaaucauuuucauccugcuuaugcugguuaccccuagcauggcgaugcgcugcgugggcauugggaacagagauuuugucgagggacucuccggcgccacauggguggacgugguccuggagcacgggagcuguguuacgaccauggcuaaaaauaagcccacacuggauaucgaacuccugaaaaccgaggugacaaacccugccgugcuucggaagcugugcauugaagcuaaaaucucuaauaccacgacagacucccgcuguccgacccaaggagaggccacccucgucgaagagcaggaugcgaacuucgugugcagacggacauuuguugaccgcggcuggggcaauggguguggacuguucggcaaggggagccuucugaccugcgccaaguuuaaaugcgugacaaagcucgagggaaaaauuguccaguacgaaaaccugaaguauucugugaucguuacggugcacaccggcgaucagcaucaagucgggaaugagacaaccgaacacggaacaaucgcuaccauuacgccccaggccccuaccuccgagauccagcugacagacuacggcgcucucacccuggacuguagccccagaacaggccuugauuucaacgaaauggugcugcucaccaugaaagagaagucuuggcugguccauaaacagugguuucuugaccugccucuccccuggacguccggggccagcacaucccaagagaccuggaaucggcaggaucugcuggugacauucaagaccgcccacgcuaagaaacaggaaguugugguccucggaucucaagagggcgcgaugcacaccgcccugacaggggcuacggaaauucagaccagcggaacaaccacaaucuuugccggccaucuuaagugccgccugaaaauggacaagcucacccugaaagggauguccuaugugauguguacgggcagcuucaagcuggagaaggaaguugccgagacacagcacggaaccgugcuuguccaggugaaauacgagggcaccgaugcuccgugcaagauuccuuuccucacacaagacgaaaaaggggugacccagaacggaagacugaucacagccaaucccaucguuacggauaaggagaaaccugucaacauugaaaccgagccccccuuuggcgagucuuauaucguggugggggcgggagaaaaggcucugaagcucuccugguucaaaaagggcagcucuauugggaaaauguuugaggccacagcccggggcgcuagacgcauggccauccugggagacaccgcuugggauuucggcagcauugggggacuuuuuacauccgucggcaagcugauccaucagguguucggggccgcguacggaguucucuuuucuggcgugagcuggaccaugaaaaucgggauuggcauccugcugacguggcuuggacucaauucccggagcaccucucuguccaugacauguauugccgucggcauggugacccuguaccucgggguuauggugcaggcugacagcggaugcgucaucaacuggaagggcagagaacugaagugugggucuggaauuuucgugacaaacgagguucacaccuggacagaacaauauaaauuucaggccgauuccccuaagcgccuuagcgcugccaucggcaaagcgugggaggagggggugugcggcauucgguccgccaccagacuggaaaauaucauguggaagcagaucucuaacgagcucaauuacauucugcuggaaaacgacaugaaauucacggucguggugggagacgcuaauggcauccuuacacaggggaagaaaaugauucgcccgcaacccauggagcauaaguauagcuggaaguccuggggaaaagccaagaucauuggcgcugauauccagaacaccaccuuuaucauugacgggccugauacacccgaauguccugacgaucagcgggccuggaauaucugggaggucgaggacuacggauucggcauuuuuaccacgaacaucuggcucaaacugagagauucuuauacacagaugugcgaccaccgccugaugagcgccgcuauuaaggauuccaaagcgguucacgccgacaugggcuacuggaucgaaagcgagaagaaugaaaccuggaagcucgcucgggccucuuucaucgaggugaaaacauguauuuggcccaagucccauacccuguggagcaacggggugcuugaaucugagaugaucauuccgaaaaucuauggaggcccuacaucccaacacaauuacagacccggguacuucacccagacggccggaccuuggcaucugggcaagcucgagcuggauuuugaccugugcgaagggaccacagucgugguugaugagcacugcggauaucgcggccccagccuucggaccacaaccgugacgggcaaaauuauccacgaaugguguugcagaucuuguacacucccuccccugcgguuccgcggggaggacggaugcugguacggcauggagaucagaccggucaaggaaaaggaggaaaaccuggugcggagcaugguuuccgcugggagcgccgagguggacucuuuuucccucggaauucugugugucagcauccuuauugaagaggugaugagaucccgcuggucucggaaaaugcugaugaccggcacacucgcgguuuuccugcugcuuaucauggggcagcugaccuggaaugaucucauuagacugugcaucauggugggagcuaacgccagcgaccgcaugggcaugggcaccacauaucucgcccugauggcuacguuuaagaugagaccuauguucgccgucgggcuucuguuucggaaacucaccucccgcgaggugcugcugcuuacaauuggacugucucucguggcgagcgucgaacugcccaauucccucgaggaacugggcgaugggcuugcuaugggaaucaugaugcugaagcuccugaccgacuuccaaccccaucagcuguggacaacccuucugucucucacguuuaucagaacaagccugucccucgauuacgccuggaaaaccauggccauggcucugagcauuguuucucuuuucccucugugucuguccaccacaagccagaagaccacauggcucccggugcugcuuggcucuuuugggugcaagccccugacgauguuccucaucaccgagaacaaaauuuggggacggaaguccuggccuaucaacgaaggcauuauggccgugggcaucgucagcauccugcucucuucccugcuuaaaaaugacgugccccuggcugggccucugauugccggaggcaugcucaucgcguguuauguuauuagcggguccagcgccgaucugucucuugagaaggcugccgaggugagcugggaagaggaagcugagcacuccggaacaucucauaacauccuggucgaagugcaggacgauggcaccaugaaaauuaaggacgaggagcgcgaugacacacucaccauccugcucaaagccacgcugcuugccguuagcgggguguaccccauguccaucccugcuacccuguuugucugguauuucuggcaaaagaagaaacagagaucuggagugcugugggauacacccagcccgccugaagucgagcgggcggugcucgacgacggcauuuaccgcauccugcagagaggccuucuggggcggucccagguuggagugggcgucuuccaagaugggguguuucacaccauguggcauguuacacgcggagccgugcucauguaccagggcaagagacuggaacccucuugggcuagcgucaaaaaggaccucauuuccuaugggggaggcuggcgguuccagggcagcuggaauaccggggaggaggugcaggugaucgccguugaaccuggaaaaaaccccaagaauguccaaacaacgccgggcaccuuuaagacaccugagggggaagugggagccauugcucuggauuucaaacccggcaccucuggguccccuaucgugaacagagagggaaagauugucggccuuuacggcaauggggugguuaccacaagcggaacguaugugucugccaucgcgcaggcuaaagccucccaggaaggcccccugcccgagaucgaggacgaagucuuuaagaaacgcaaccugaccauuauggaucuccacccugggagcggaaagacacggagauaccugccggccaucgugcgcgaggcuauuaagcggaaacuuagaacccugauccucgcccccacacgcguuguggcguccgaaauggcugaggcccugaagggcaugccuauucgguaucaaaccacggccgucaaaucugaacacacagggagagagaucguggaccugaugugccaugcuaccuucaccaugcgccuccuuagccccguucgggugccuaauuacaacaugaucauuauggaugaggcccacuuuacagaccccgcuuccaucgccgcgagaggcuauauuagcacccgggucggaaugggcgaagccgcugccaucuucaugacagcuaccccuccggggucuguggaggccuuuccccaguccaaugccgugauucaggaugaagagcgcgacaucccugaaagaagcuggaacucuggauacgauuggaucacggacuuccccggcaagacagucugguuuguuccuagcauuaaauccgggaaugacaucgcuaacugucugcggaagaauggaaagcgcgugauucagcugucuagaaaaaccuucgauacagaguaccaaaagaccaaaaacaacgacugggauuauguggucacgaccgacaucagcgagaugggcgcgaauuuccgggccgauagagugauugacccccgccggugccucaagccgguuauccugaaagaugggccugaaagagugauucuugcuggccccaugcccgucacaguggccuccgccgcucagcgccggggaagaaucggccgcaaccagaauaaggagggggaccaguacaucuauaugggacaaccucugaacaaugaugaagaccaugcccacuggaccgaggcgaagaugcuccuggauaacauuaauacacccgagggcaucauuccugcucuguuugaaccggagcgggaaaaaucugccgccaucgacggggaguacagacuccgcggagaagcuagaaagaccuucguugagcuuaugcggcgcggcgaucugcccguguggcugagcuauaaagucgccuccgagggguuucaguacagcgacagacgguggugcuucgacggcgaacgcaacaaucaggugcucgaggaaaacauggaugucgagauuuggacaaaggaaggagagagaaaaaagcugcggccuagauggcuugacgcgcgcaccuauucugauccccuggcccuccgggaguuuaaagaauucgcugccggcagacgcuccgugagcggggaccugauccuggagaucggaaagcucccucagcaucuuacgcugcgggcucaaaaugcccuggauaaccucguuaugcugcacaauuccgaacagggcgggaaggcuuacagacacgccauggaggaacuucccgacacaauugagacccugaugcuccuggcgcugaucgccgugcucaccggaggcgugacacuuuuuuuccugucuggcaaagggcugggaaagaccagcauuggccuccugugugucauggcuuccucugcccuucuguggauggcuagcguugagccgcauuggaucgccgccuccauuauccucgaauuuuuccugauggugcugcucaucccugagcccgaucggcagcgcacaccucaggacaaccaacuugcuuacguggucauugggcugcuguuuaugauccucacgguggcggccaaugaaaugggacugcuugagaccacaaaaaaggaucugggcauugggcacguugcugccgagaaccaucaccacgccaccaugcucgacguggaucugagacccgcuagcgccuggacacuguaugcggucgccaccacggugaucaccccuaugaugcggcauacaauugaaaacaccacagcuaauaucucucucaccgccauugcuaaccaggccgcgauccuuaugggacuggacaaaggcuggcccaucuccaagauggauauuggcgucccgcugcucgcccuggggugcuacagccaggugaauccucuuacgcugacagcuaccguucucaugcugguggcccacuaugcuaucauuggacccggccugcaagccaaggcuacacgcgaggcccagaaaagaaccgcggccgggaucaugaagaaccccaccgucgacggaauugugacaaucgaccucgauccuguuguguacgacgcuaaauucgaaaagcagcuuggccagaucaugcugcugauucucuguacgucucaaauccugcuuaugcggaccacaugggcccugugcgaguccauuacccucgcuacagggccgcugaccacgcugugggaaggaagccccggcaaauuuuggaauacaaccaucgccgucucuauggccaacauuuuccgcggcagcuaucucgcgggggcuggacuugccuucucccugaugaagucucugggcgggggaagacggggcaccggggcucagggagagacacucggcgagaaguggaaacgccagcugaaucagcuuagcaaguccgaauuuaacaccuacaaaaagagcggcaucauggagguggauagauccgaagccaaagaggggcugaagcggggagaaacaacgaagcaugccgugucuagaggcaccgcuaaacuccgcugguucguugagcggaaucuggucaagccugaggggaaagugaucgaccugggauguggcagagggggauggagcuauuacugcgccggccucaagaaagugacagaagucaagggcuacaccaaagggggacccggccacgaggaaccuauucccauggcgacauauggguggaaccuuguuaagcugcauuccggaaaggauguguuuuucaccccuccggagaaaugugacacgcugcucugcgauaucggcgaaucuagccccaauccuaccauugaggaggggcgcacacugcgggugcuuaagauggucgaacccuggcugagaggaaaccaauuuuguaucaaaauucucaauccuuacaugcccuccgugguugagacccuggaacagaugcagcgcaagcacggcggcaugcuggugcggaacccgcucucuagaaauagcacacacgagauguauugggucuccugcgggaccggaaacaucgugagcgccguuaauaugacaucucgcaugcugcuuaaccgguucaccauggcucauagaaaaccuacguacgagcgcgacguggaucugggcgccgggacacggcacgucgcuguggaacccgagguggccaaccucgacauuaucggacagagaaucgaaaauauuaagaacgagcauaaguccaccuggcacuaugaugaagacaaucccuacaaaaccugggcguaucacggcagcuacgaggucaagccuucuggguccgccagcucuaugguuaacggaguggugcgccugcuuacaaaacccugggacgucaucccuauggugacgcaaauugcuaugaccgauacaaccccguuuggccagcagagaguuuucaaggagaaaguggacacacggaccccccgcgccaagagaggcacagcucaaaucauggaagucaccgccaaguggcuguggggguuucucucccggaauaaaaagccuagaauuuguacgcgggaggaauucacccgcaaagugagaagcaacgcugccaucggagcgguuuuuguggaugagaaucaguggaacuccgccaaggaagcugucgaggacgagcgguucugggaucuggugcaucgcgaaagagagcugcacaaacagggcaagugcgccacaugcguuuacaauaugauggggaagcgggaaaaaaagcucggagaguuuggcaaagcuaaggggagccgcgccaucugguauauguggcugggcgccagauuccuugaauucgaggcgcugggauuuaugaacgaggaccauugguucucucgggaaaauagccucuccggcguggagggggaaggacugcacaaacuuggcuacauucugcgcgauaucucuaagauucccgggggaaacauguaugcugacgauaccgccggcugggacacaagaaucaccgaggaugaccuccagaaugaggccaaaauuacggauaucauggaaccugagcaugcucugcuggccacaagcaucuuuaagcucaccuaccaaaacaaggucgugcggguccagcgccccgcuaaauccgggacagugauggacguuauuucuagacgggaccagcgcggcagcggacaggugggcaccuaugggcugaauacguucaccaacauggaaguccaacuuaucagacagauggaguccgaaggaauuuuuucuccgagcgagcuggagacaccuaaccucgccaagcgggugcuggauuggcuugaaaaacacggcgcggagagacugaagcgcauggccaucuccggggacgauugugugguuaaacccauugacgaucgguucgcuaccgcccucacagcucugaaugacaugggaaaggugagaaaggauaucccucagugggaacccagcaaaggcuggaacgacuggcagcaagucccuuuuugcucucaccauuuccaccagcugaucaugaaggaugggcgcgacauugugguucccugucggaaucaggaugagcucgugggcagagcccgcgucucccagggagcgggcuggagccugcgggaaaccgccugccuugggaaaucuuacgcucaaauguggcagcugauguauuuucauagacgcgaccuccggcuggccgcuaacgccaucuguuccgcugugccggucgacugggugccuacaagcagaaccacgugguccauucacgcccaccaucaguggaugacaaccgaggauaugcuuucuguuuggaaucgcguguggaucgaggaaaaccccuggauggaggacaagacccacgucagcuccugggaagaggugcccuaccugggaaaacgggaagaucaauggugcggcagccucauugggcugacagcgagagccaccugggcuacaaauauccagguugccauuaaccaggugcggagacugaucggaaaugagaacuaccucgacuauaugacgucuaugaagcgcuucaagaaugaguccgauccugaaggcgcccugugguga

SEQ ID NO: 18502 - RNA, 9879 nt, Artificial Sequence
  derived and/or modified CDS sequence (opt5) from DENV-1__FJ850087__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacgugaauggcauccuugcucaggggaagaaaaugauucgcccgcaacccauggagcauaaguauagcuggaaguccuggggaaaagccaagaucauuggcgcugauauccagaacaccaccuuuaucauugacgggccugauacacccgaauguccugacgaucagcgggccuggaauaucugggaggucgaggacuacggauucggcauuuuuaccacgaacaucuggcucaaacugagagauucucacacacagaugugcgaccaccgccugaugagcgccgcuauuaaggauuccaaagcgguucaugccgacaugggcuauuggaucgaaagcgagaagaaugaaaccuggaagcucgcucgggccucuuucaucgaggugaaaacauguauuuggcccaagucccacacccuguggagcaacggggugcuugaaucugagauggucaucccgaaaauuuacggaggcccuaucucccaacauaauuauagacccggguacuucacacagaccgccggaccuuggcaccugggcaagcucgagcuggauuuugaccugugcgaagggacgaccgugguuguggaugagcacugcggauaccgcggccccagccuucggacaaccacagucaccggcaaaauuauccaugaaugguguugcagaucuuguacgcucccuccccugcgguuccgcggggaggacggaugcugguauggcauggagaucagaccggugaaggaaaaggaggaaaaccugguucggagcaugguguccgcugggagcggagaggucgacucuuuuucccucggcauucugugugugagcauccuuauugaagagguuaugagaucccgcuggucucggaaaaugcugaugacagggacccucguggucuuccugcugcuuaucaugggacagcugacauggaaugaucucauuagacugugcaucauggugggcgccaacgcgagcgaccgcaugggcauggggaccaccuaccucgcucugauggccacauuuaagaugagaccuauguucgccgugggacuucuguuucggcgccucacguccagagagguccugcugcuuaccguuggccugucucucguggcuagcguggaacugcccaauucccucgaggaacugggggauggacuugccaugggcauuaugaugcugaaacuccugacagacuuccaaccccaccagcuguggaccacacuucugucucucaccuuuauccggacgagccugucccucgauuaugcguggaagacaauggcuauggcccugagcaucgucucucuuuucccucugugucuguccaccaccagccagaaaacaaccuggcucccggugcugcuugggucuuuuggaugcaagccccugacaauguuccucauuacggagaacaagaucuggggccgcaaauccuggccuauuaacgaaggcaucauggccguugggauugugagcauccugcucucuucccugcuuaagaaugacgucccccuggcuggaccucugaucgccggcgggaugcucauugcuuguuacgugaucagcggauccagcgccgaucugucucuugagaaagcggccgagguuagcugggaagaggaagcugagcauuccggcaccucucacaacauucugguggaaguccaggacgaugggacaaugaagaucaaagacgaggagagagaugacacccucacaauucugcucaaggccacccugcuugcugugagcggagucuaucccauguccaucccugccacgcuguuugugugguacuucuggcaaaaaaagaagcagcggucuggcguucugugggauacccccagcccgccugaaguggagcgcgccguccucgacgacggcaucuauagaauucugcagcgggggcuucugggacgcucccaggugggcguuggggugcuccaagauggagucuuccauacaauguggcacgugaccagaggcgcugugcugauguaccaggggaaacggcucgaacccucuugggcgagcguuaagaaagaccugaucuccuacggaggcggcuggagauuucaggggagcuggaauacaggagaggagguccaggugauugccguggaaccuggcaagaaccccaaaaauguccaaaccacaccggggacguucaagaccccugagggagaagugggcgcuaucgcccuugauuuuaagcccgggacaucuggauccccuauuguuaaccgcgagggcaaaaucgugggccuguaugggaauggagucgugaccaccagcggcacauacguuucugccauugcucaggccaaggcgacgcaggaagggccccugcccgagaucgaggacgaaguguucaaaaagcggaaccucaccaucauggaucugcacccuggauccggcaaaacaagacgcuaucuuccggcuauuguccgggaggccaucaagagaaagcugcgcacccucauucuggcccccacacgggugguugcuagcgaaauggccgaggcgcugaaagggaugccuaucagauaccaaaccacggcugugaaguccgaacauacaggccgcgagauugucgaccucaugugccacgccaccuuuaccaugcggcuucugucucccgugagagugccuaauuauaacaugaucaucauggaugaggcccauuucacagaccccgcuagcauugccgcucggggauacaucuccacccgcgucggcaugggggaagccgcggccauuuuuaugacagcuaccccuccgggaagcguugaggccuucccccagucuaaugcugugauccaggaugaagagagagacauuccugaacgguccuggaacagcggcuaugauuggaucacggacuuucccgggaaaacagugugguucgucccuucuaucaagagcggaaaugacauugccaacugucugcgcaaaaauggcaagagagugauccagcucucccggaagaccuuugauacagaguaccaaaaaaccaagaacaacgacugggauuacguugugacgaccgacauuucugagaugggggccaauuucagagcugaucgcgucaucgacccccggagaugccugaaaccggugauucuuaaggaaggcccugagcgcguuauccuggcgggacccaugcccgugacagucgccagcgcugcccagcggagaggccgcauugggcggaaccagaauaaagaaggagaucaguauaucuacaugggccaaccucucaacaaugacgaggaucacgcccauuggaccgaggcuaagaugcugcuggacaacaucaauacacccgaagggauuaucccugcccucuucgagccggaaagagagaaguccgcggcuauugauggagaauaucgccuuagaggcgaggcccggaaaaccuuuguggagcugaugcgcagaggggaccugcccgucuggcucucuuacaagguggccagcgaaggcuuccaguauuccgaucggcgcuggugcuuugacggagagagaaacaaucagguucuggaagagaacauggacguggaaaucuggacaaaagagggcgagcggaagaaacuuagaccucgcuggcuggaugcucggaccuacagcgacccccucgcccugagagaauucaaggaguuugcggccgggcgccggucuguguccggagaucugauucucgaaaucggcaaacuuccucagcaccugacgcugagagcucaaaaugcccucgacaaccuggucaugcuucacaauagcgagcaggggggaaaggcuuaucggcaugccauggaagagcugcccgauacaaucgagacccucaugcugcuggcucucauugccguucuuaccggcggcgugacacuguucuuucuguccgggaagggacucggcaaaaccucuaucgggcugcuuugugugauggcgagcuccgcccugcucuggauggcuucugucgaaccgcacuggauugccgcuagcaucauucuggaguucuuucugauggugcuccuuaucccugaacccgaccgccagagaacaccucaggauaaccaacuggccuacguugugaucggacugcucuucaugauucugacggucgccgcuaaugagaugggccuucuggagaccacaaagaaagaccucgggaucggacauguggcggucgaaaaccaccaccaugccaccaugcuggauguggaccugcggcccgcuuccgccuggacacucuacgccguugcuaccacggugauuaccccuaugaugcgccacacaaucgagaacaccacagccaauauuagccuuaccgcgaucgccaaccaggcugccauucugaugggccuggauaagggcuggcccaucucuaaaauggacaucggggucccgcuccuggcucuuggaugcuauucccaggugaauccucugacgcucacagccgcgguucugaugcugguggcccauuacgcuauuaucggccccgggcuccaagccaaggcuaccagagaagcccagaagcggacagcugccggaauuaugaaaaaccccaccgucgauggcaucgugaccauugaccuugacccugugguuuaugaugcgaaguuugagaaacagcuggggcagaucaugcugcucauccuguguacaagccaaauucuucugaugcgcacgaccugggcccucugcgaaucuaucacacuggcuaccggaccgcugacaacccucugggagggcucccccggcaaguucuggaauacgacaauugccgucagcauggcuaacaucuuuagagggucuuaccuugccggagccggccuggcguucagccugaugaaaucccucgggggaggccggcgcgggaccggagcucagggcgagacccugggcgaaaaguggaagagacagcuuaaucagcugucuaaaagcgaguucaacacauauaagaaauccgggauuauggaaguggaccggagcgaggccaaggaaggacucaaaagaggcgagaccacaaagcacgcugugucccgcgggacggccaagcugcggugguuugucgagagaaaucugguuaaaccugaaggaaaggugaucgaucucggcugugggcgcggaggcuggucuuacuauugcgccggccuuaaaaaggugaccgaggucaaaggguacacaaagggaggccccgggcaugaagagccuauccccauggcuaccuacggauggaaccuggugaaacugcacagcggcaaggacguuuucuuuacaccuccggaaaagugugauacccuccugugcgacauuggggaguccucucccaauccuacgaucgaggaaggacggacccuuagagugcugaaaauggucgagcccuggcuccgcggcaaccaauucuguauuaagauccugaauccuuauaugcccagcgugguugaaacacuggagcagaugcagcggaaacacggcgggaugcucgugagaaacccgcugucccgcaauucuacccaugagauguacugggucagcugcggaacaggcaacauuguguccgccgugaauaugaccagccggaugcuucugaacagauuuacaauggcgcaccgcaagccuaccuaugaacgggaugucgaccucggggccggaacgagacauguugcuguggagcccgaaguggccaaccuggauaucauuggccagcgcaucgagaauaucaaaaacgaacacaagucuacauggcacuacgacgaggauaaucccuauaagaccugggcuuaccauggguccuaugaggucaaaccuagcggaucugccuccagcauggugaacggcguugugagacuucugaccaagcccugggacgucauuccuauggugacacaaaucgcgaugacggacaccacaccguucggccagcagcggguuuuuaaagaaaagguggauacccgcacacccagagccaaacgggggaccgcucaaauuauggaggucacagccaaguggcucuggggauuccugucuagaaauaagaaaccucggaucuguacccgcgaagaguuuacgagaaaggugcgguccaacgcugccauuggcgcuguuuucguggacgaaaaucaguggaacagcgccaaagaggcggucgaggaugaacgcuuuugggaccuggugcacagagagcgggaacuccauaagcaggggaaaugcgccaccugcgucuacaauaugaugggaaagcgcgagaagaaacugggcgaauucgggaaggcuaaaggcuccagagccaucugguacauguggcuuggagcucgguuucuggaguucgaggcccucggcuucaugaacgaagaucacugguuuagccgcgagaauucucugagcgggguggaaggagagggccuucauaagcugggguauauccucagagacauuuccaaaauccccggaggcaacauguacgccgaugacacagcggggugggauacccggauuacagaggacgaucugcagaaugaagcuaagaucaccgacauuauggagccugaacacgcccugcucgccacgucuaucuucaaacugacauaucaaaacaagguugugcgcguccagagacccgcuaagagcggcaccgugauggaugugaucucccggcgcgaccagagaggaucuggccagguugggacauacggacuuaauaccuuuacgaacauggaggugcaacugauucggcagauggaaagcgagggcaucuucuccccgucugagcucgaaaccccuaaccuggccaaaaagguccuugacuggcuggagaaacacggggcugaaagacucaagcgcauggccauuagcggagaugacugugugguuaaacccaucgaugaccgguuugcgacagcccugaccgcucugaaugauaugggcaaggugagaaaggacauuccucagugggagcccuccaaaggguggaacgauuggcagcaagucccuuucugcagccaucacuuucaucagcucaucaugaaggacggccgcgaaaucgugguccccugucggaaucaggaugagcuggugggaagagcccgcguuucucagggcgcuggguggucccuucgggagacagccugccugggaaaaagcuaugcgcaaauguggcagcucauguacuuccacagacgcgaccugcggcuugccgcuaacgccauuuguucugcugugccggucgauugggugccuaccuccagaacaaccuggagcauccacgcccaucaccaguggaugacgacagaagacaugcuguccguuuggaaucgcguguggauugaggaaaaccccuggauggaggacaagacccaugucucuagcugggaagaggugcccuaucucggcaaacgggaggaucaauggugcgggucccugaucggacugaccgcuagagccacaugggcgaccaauauucagguggccaucaaccagguucggagacucauuggcaaugaaaacuaccuggacuacaugacaagcaugaagcgcuuuaagaaugagucugauccugaaggggcucuuugguga

SEQ ID NO: 18503 - RNA, 9879 nt, Artificial Sequence
  derived and/or modified CDS sequence (opt5) from DENV-1__FJ850090__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagagguggaacccgacgaugucgacuguuggugcaaugcgaccgauacgugggugaccuauggaacauguucccaaaccggcgagcacagacgggacaagcgcucuguugcucuggccccucauguggggcucggacuggagacaagaaccgaaacguggaugagcuccgagggcgccuggaaacagauucagaaggucgaaacaugggcucuucggcaccccggcuucaccgugaucgcccuguuucucgcucaugccauugggacaucuaucacccagaagggaaucauuuucauccugcuuaugcugguuaccccuagcauggcgaugcgcugcgugggcauugggaacagagauuuugucgagggacucuccggcgccacauggguggacgugguccuggagcacgggagcuguguuacgaccauggcuaaaaauaagcccacacuggauaucgaacuccugaaaaccgaggugacaaacccugccgugcuucggaagcugugcauugaagcuaaaaucucuaauaccacgacagacucccgcuguccgacccaaggagaggccacccucgucgaagagcaggaugcgaacuucgugugcagacggacauuuguugaccgcggcuggggcaauggguguggacuguucggcaaggggagccuucugaccugcgccaaguuuaaaugcgugacaaagcucgagggaaaaauuguccaguacgaaaaccugaaguauucugugaucguuacggugcacaccggcgaucagcaucaagucgggaaugagacaaccgaacacggaacaaucgcuaccauuacgccccaggccccuaccuccgagauccagcugacagacuacggcgcucucacccuggacuguagccccagaacaggccuugauuucaacgaaauggugcugcucaccaugaaagagaagucuuggcugguccauaaacagugguuucuugaccugccucuccccuggacguccggggccagcacaucccaagagaccuggaaucggcaggaucugcuggugacauucaagaccgcccacgcuaagaaacaggaaguugugguccucggaucucaagagggcgcgaugcacaccgcccugacaggggcuacggaaauucagaccagcggaacaaccacaaucuuugccggccaucuuaagugccgccugaaaauggacaagcucacccugaaagggauguccuaugugauguguacgggcagcuucaagcuggagaaggaaguugccgagacacagcacggaaccgugcuuguccaggugaaauacgagggcaccgaugcuccgugcaagauuccuuuccucacacaagacgaaaaaggggugauccagaacggaagacugaucaccgccaaucccauuguuacagauaaggagaaaccugucaacaucgaaacggagccccccuuuggcgagucuuauauuguggugggggcgggagaaaaggcucugaagcucuccugguucaaaaagggcagcucuaucgggaaaauguuugaggccaccgcccggggcgcuagacgcauggccauucugggagacacagcuugggauuucggcagcaucgggggacuuuuuaccuccgucggcaagcugauccaucagguguucgggacagccuacggaguucucuuuucuggcgugagcuggaccaugaaaauugggaucggcauucugcugacguggcuuggacucaauucccggagcaccucucuguccaugacauguaucgcggucggcauggugacccuguaccucgggguuauggugcaggccgacagcggaugcgucauuaacuggaagggcagagaacugaagugugggucuggaaucuucgugacaaacgagguucacaccuggacagaacaauauaaauuucaggcugauuccccuaagcgccuuagcgccgcuauuggcaaagccugggaggagggggugugcggcauccgguccgcgaccagacuggaaaauaucauguggaagcagauuucuaacgagcucaauuacauccugcuggaaaacgacaugaaauucacggucguggugggagacgccaauggcauucuuacacaggggaagaaaaugauccgcccgcaacccauggagcauaaguauagcuggaaguccuggggaaaagcuaagauuaucggcgccgauauccagaacaccaccuuuauuaucgacgggccugauacacccgaauguccugacgaucagcgggcuuggaauauuugggaggucgaggacuacggauucggcaucuuuaccacgaacauuuggcucaaacugagagauucucacacacagaugugcgaccaccgccugaugagcgccgccaucaaggauuccaaagcuguucaugcggacaugggcuauuggaucgaaagcgagaagaaugaaaccuggaagcucgcccgggcuucuuucauugaggugaaaacauguaucuggcccaagucccacacccuguggagcaacggggugcuugaaucugagaugauuaucccgaaaauuuacggaggcccuacaucccaacauaauuauagacccggguacuucacccagacggccggaccuuggcaccugggcaagcucgagcuggauuuugaccugugcgaagggaccacagucgugguugaugagcacugcggauaccgcggccccagccuucggaccacaaccgugacgggcaaaaucauccaugaaugguguugcagaucuuguacacucccuccccugcgguuccgcggggaggacggaugcugguauggcauggagauuagaccggucaaggaaaaggaggaaaaccuggugcggagcaugguuuccgccgggagcggagagguggacucuuuuucccucggcauccugugugucagcauucuuaucgaagaggugaugagaucccgcuggucucggaaaaugcugaugaccgggacacucgcuguuuuccugcugcuuauuaugggacagcugaccuggaaugaucucaucagacugugcauuauggugggcgccaacgcgagcgaccgcaugggcauggggaccacauaccucgcucugauggccacguuuaagaugagaccuauguucgccgucggacuucuguuucggaaacucaccucccgcgaggugcugcugcuuacaaucggccugucucucguggcuagcgucgaacugcccaauucccucgaggaacugggggauggacuugccaugggcaucaugaugcugaagcuccugaccgacuuccaaccccaccagcuguggacaacccuucugucucucacguuuauuagaacaagccugucccucgauuaugcguggaaaaccauggcuauggcccugagcaucguuucucuuuucccucugugucuguccaccacaagccagaagaccacauggcucccggugcugcuugggucuuuuggaugcaagccccugacgauguuccucauuaccgagaacaaaaucuggggccggaaguccuggccuauuaacgaaggcaucauggccguggggaucgucagcauucugcucucuucccugcuuaaaaaugacgugccccuggcuggaccucugaucgccggcgggaugcucauugcuuguuacguuaucagcggauccagcgccgaucugucucuugagaaggcggccgaggugagcugggaagaggaagcugagcauuccggcacaucucacaacauucuggucgaagugcaggacgaugggaccaugaaaaucaaggacgaggagcgcgaugacacacucaccauccugcucaaagccacgcugcuugcuguuagcggaguguaucccauguccauuccugccacccuguuugucugguacuucuggcaaaagaagaaacagagaucuggcgugcugugggauacacccagcccgccugaagucgagcgggccgugcucgacgacggcaucuaucgcauucugcagagagggcuucugggacggucccagguuggcgugggggucuuccaagauggaguguuucauaccauguggcacguuacacgcggcgcugugcucauguaccaggggaagagacuggaacccucuugggcgagcgucaaaaaggaccucaucuccuacggaggcggcuggcgguuccaggggagcuggaauaccggagaggaggugcaggugauugccguugaaccuggcaaaaaccccaagaauguccaaacaacgccggggaccuuuaagacaccugagggagaagugggcgcuaucgcccuggauuucaaacccgggaccucuggauccccuauugugaacagagagggcaagaucgucggccuuuaugggaauggagugguuaccacaagcggcacguacgugucugccaucgcucaggccaaagcgucccaggaagggccccugcccgagauugaggacgaagucuuuaagaaacgcaaccugaccaucauggaucuccacccuggaagcggcaagacacggagauaucugccggcuauugugcgcgaggccaucaagcggaaacuuagaacccugauucucgcccccacacgcguuguggcuuccgaaauggccgaggcgcugaaggggaugccuauccgguaccaaaccacggcugucaaaucugaacauacaggcagagagaucguggaccugaugugccacgccaccuucaccaugcgccuccuuagccccguucgggugccuaauuauaacaugauuaucauggaugaggcccauuuuacagaccccgcuuccauugccgcuagaggauacaucagcacccgggucggcaugggggaagccgcggccauuuucaugacagcuaccccuccgggaucuguggaggccuuuccccaguccaaugcugugauccaggaugaagagcgcgacaucccugaaagaagcuggaacucuggcuaugauuggauuacggacuuccccgggaagacagucugguuuguuccuagcaucaaauccggaaaugacauugccaacugucugcggaagaauggcaagcgcgugauccagcugucuagaaaaaccuucgauacagaguaccaaaagaccaaaaacaacgacugggauuacguggucacgaccgacauuagcgagaugggggccaauuuccgggcugauagagugaucgacccccgccggugccucaagccgguuauucugaaagauggcccugaaagagugauccuugcgggacccaugcccgucacaguggccuccgcugcccagcgccggggcagaaucgggcgcaaccagaauaaggagggagaccaguauauuuacaugggccaaccucugaacaaugaugaagaccacgcccauuggaccgaggcuaagaugcuccuggauaacaucaauacacccgaggggauuaucccugcccuguuugaaccggagcgggaaaaaucugcggcuauugacggagaguauagacuccgcggcgaagccagaaagaccuucguugagcuuaugcggcgcggggaucugcccguguggcugagcuacaaagucgccuccgagggcuuucaguauagcgacagacgguggugcuucgacggagaacgcaacaaucaggugcucgaggaaaacauggaugucgagaucuggacaaaggaaggcgagagaaaaaagcugcggccuagauggcuugacgcucgcaccuacucugauccccuggcccuccgggaguuuaaagaauucgcggccgggagacgcuccgugagcggagaccugauccuggagauuggcaagcucccucagcaccuuacgcugcgggcucaaaaugcccuggauaaccucguuaugcugcacaauuccgaacaggggggaaaggcuuauagacaugccauggaggaacuucccgacacaaucgagacccugaugcuccuggcucugauugccgugcucaccggcggcgugacacuuuuuuuccugucugggaaaggacugggcaagaccagcaucgggcuccugugugucauggcguccucugcccuucuguggauggcuagcguugagccgcacuggauugccgcuuccaucauccucgaauuuuuccugauggugcugcucauuccugagcccgaucggcagcgcacaccucaggacaaccaacuugccuacguggucaucggacugcuguuuaugauucucacgguggccgcuaaugaaaugggccugcuugagaccacaaaaaaggaucuggggaucggacauguugcggccgagaaccaccaccaugcuaccaugcucgacguggaucugagacccgccagcgccuggacacuguacgcugucgccaccacggugauuaccccuaugaugcggcacacaaucgaaaacaccacagcgaauauuucucucaccgccaucgcuaaccaggccgcuauccuuaugggccuggacaaaggcuggcccauuuccaagauggauaucggggucccgcugcucgcccugggaugcuauagccaggugaauccucuuacgcugacagcgaccguucucaugcugguggcccauuacgcuauuaucggccccgggcugcaagccaaggcuacacgcgaggcccagaaaagaaccgcugccggaauuaugaagaaccccaccgucgacggcaucgugacaaucgaccucgauccuguuguguaugacgcgaaauucgaaaagcagcuugggcagauuaugcugcugauccucuguacgucucaaauucugcuuaugcggaccacaugggcccugugcgaguccaucacccucgcuacaggaccgcugaccacgcugugggaaggcagccccggcaaauuuuggaauacaaccauugccgucucuauggcuaacaucuuccgcgggagcuaccucgccggagccggccuugcguucucccugaugaagucucuggggggaggcagacgggggaccggagcucagggcgagacacucggcgagaaguggaaacgccagcugaaucagcuuagcaaguccgaauuuaacaccuauaaaaagagcgggaucauggagguggauagauccgaagccaaagagggacugaagcggggcgaaacaacgaagcacgcugugucuagagggaccgccaaacuccgcugguucguugagcggaaucuggucaagccugagggaaaagugauugaccugggcugugggagaggaggcuggagcuacuauugcgccggccucaagaaagugacagaagucaagggguacaccaaaggaggccccgggcaugaggaaccuauccccauggcuacauacggauggaaccuuguuaagcugcacuccggcaaggauguguuuuucaccccuccggagaaaugugacacgcugcucugcgauauuggggaaucuagccccaauccuaccaucgaggagggacgcacacugcgggugcuuaagauggucgaacccuggcugagaggcaaccaauuuuguauuaaaauccucaauccuuauaugcccuccgugguugagacccuggaacagaugcagcgcaagcacggcgggaugcuggugcggaacccgcucucuagaaauagcacacaugagauguacugggucuccugcggaaccggcaacauugugagcgccguuaauaugacaucucgcaugcugcuuaaccgguucaccauggcgcacagaaaaccuacguaugagcgcgacguggaucugggggccggaacacggcaugucgcuguggaacccgagguggccaaccucgacaucaucggccagagaauugaaaauaucaagaacgagcacaaguccaccuggcacuacgaugaagacaaucccuauaaaaccugggcuuaccaugggagcuaugaggucaagccuucuggauccgccagcucuaugguuaacggcguggugcgccugcuuacaaaacccugggacgucauuccuauggugacgcaaaucgcgaugaccgauacaaccccguuuggccagcagagaguuuucaaggagaaaguggacacacggaccccccgcgccaagagagggacagcucaaauuauggaagucaccgccaaguggcugugggauuuucucucccggaauaaaaagccuagaaucuguacgcgggaggaauucacccgcaaagugagaagcaacgcugccaucggagcuguuuuuguggacgagaaucaguggaacuccgccaaggaagcggucgaggaugagcgguucugggaccuggugcaccgcgaaagagagcugcauaaacagggcaagugcgccacaugcguuuacaauaugauggggaagcgggaaaaaaagcucggagaguuuggcaaagcuaaggggagccgcgccauuugguacauguggcugggcgcuagauuccuugaauucgaggcccugggauuuaugaacgaggaucacugguucucucgggaaaauagccucuccggcguggagggggaaggacugcauaaacuuggcuauauccugcgcgacauuucuaagauccccgggggaaacauguacgccgaugacaccgcgggcugggauacaagaauuaccgaggacgaucuccagaaugaggcuaaaaucacggacaucauggaaccugagcacgcccugcuggccacaagcauuuuuaagcucaccuaucaaaacaaggucgugcggguccagcgccccgcuaaauccgggacagugauggacguuaucucuagacgggaucagcgcggcagcggacaggugggcaccuacgggcugaauacguucaccaacauggaaguccaacuuauuagacagauggaguccgaaggaaucuuuucuccgagcgagcuggagacaccuaaccucgccaagcgggugcuggacuggcuugaaaaacacggcgcugagagacugaagcgcauggccauuuccggggaugacugugugguuaaacccaucgaugaccgguucgcgaccgcccucacagcucugaaugauaugggaaaggugagaaaggacaucccucagugggaacccagcaaaggcuggaacgauuggcagcaagucccuuuuugcucucaucacuuccaucagcugauuaugaaggacgggcgcgauaucgugguucccugucggaaucaggacgagcucgugggcagagcccgcgucucccagggagcuggcuggagccugcgggaaaccgccugccuugggaaaucuuaugcgcaaauguggcagcugauguacuuucacagacgcgaccuccggcuggccgcuaacgccauuuguuccgcugugccggucgauugggugccuacaagcagaaccacgugguccauccacgcccaucaccaguggaugacaaccgaggacaugcuuucuguuuggaaucgcguguggauugaggaaaaccccuggauggaggauaagacccaugucagcuccugggaagaggugcccuaucugggaaaacgggaagaccaauggugcggcagccucaucgggcugacagcuagagccaccugggcgacaaauauucagguugccaucaaccaggugcggagacugaucggaaaugagaacuaccucgauuacaugacgucuaugaagcgcuucaagaaugaguccgacccugaaggcgcucugugguga

SEQ ID NO: 18504 - RNA, 9879 nt, Artificial Sequence
  derived and/or modified CDS sequence (opt5) from DENV-1__FJ850093__SS-prME
agcgugaccaugcugcucaugcugcuucccaccgcccuggcuuuccaccucacgaccagaggcggggaaccucauaugaucgucuccaagcaggaacggggaaagucucugcuuuuuaagacaagcgccggcguuaauaugugcacccugauugccauggaccucggggaacugugugaagauacaaugaccuacaagugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaucgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccgcccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaaacuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacacaccuggcucucauggccacguuuaaaaugcggccuauguucgcggucggccugcucuuucgcagacugaccucucgggaggugcuucugcucacaaucgggcugagccugauggcuuccauggaacuucccaacucucuggaggaacucggagacggccuggccauggggauuaugaugcucaagcugcuuaccgaguuccaaccccaucagcuguggacaacccuccugagccugacguuugugaaaacaacccuuucccuggauuaugccuggaagaccacagcuaugauccucagcaucgucucucuguucccucucugucuguccaccacaagccagaaaacgaccuggcuuccgguucugcugggaucuuuuggcugcaagccccucacaauguuccugauuaccgaaaacaagaucuggggccgcaaauccuggccucuuaaugaggggauuauggccaucggaauugugagcauccugcucucuucccugcucaagaacgacgugccccuggcuggcccucuuaucgccgggggaaugcugauugcguguuacgucaucagcggcuccagcgccgaucugucucucgagaaagcugccgaagugagcugggagcaggaagcugagcacuccggggccucucauaauauucugguugaagugcaagacgauggaacaaugaagaucaaagacgaggagagagaugacacccuuacgauucugcucaaggccacccugcucgcugucagcggcguguaucccauguccaucccugcgacacuguuuguuugguacuucuggcagaaaaagaagcagcggucuggcgugcuuugggauacccccagcccgccugaagucgagcgcgccgugcuggacgaugggaucuaucgcauucugcagcggggacuccugggccgcucccaagucggggugggaguuuuccaggacggcguguuucacacaauguggcacgucaccagaggggcugugcuuauguaccagggaaaacggcuggaacccucuugggccagcguuaagaaagaccucaucuccuauggcggcggguggagauuccagggaagcuggaacacaggcgaggaggugcaagucauugccguggaaccugggaagaaucccaaaaacgugcagacgaccccgggaacauuuaagaccccugagggcgaaguuggggcuaucgcccuggauuucaagcccggaaccucuggcuccccuauugucaaucgcgagggcaaaaucguggggcucuacggaaacggcguggucacaacgagcgggaccuacgugucugcgauugcucaggccaaggccucccaagaaggaccccugcccgagaucgaggacgaaguuuuuaaaaagcggaaucuuacaaucauggaucugcauccuggcagcgggaaaaccagacgcuaucugccggcuauugugcgggaggccaucaagagaaagcuccgcacacugauucuugcgcccacccgggucguggcuuccgaaauggccgaggcccugaaaggcaugccuaucagauaccagacgacagcuguuaagucugaaaccaccggacgcgagauuguggaccucaugugccacgccacauucaccaugcggcugcugagccccgucagagugccuaacuauaauaugaucaucauggaugaggcucauuuuacagaccccgccuccauugcggcccggggcuacaucagcacccgcguugggaugggagaagcugccgcuauuuucaugacggccacaccuccgggcucuguggaggccuuuccccaguccaacgcugucauccaggaugaagagagagacauuccugaacggagcuggaacucuggguaugauuggaucaccgacuuccccggaaaaacagugugguuugugccuagcaucaaguccggcaacgauauugcgaauugucuccgcaaaaacgggaagagagucauccaacuuucucggaagaccuucgacacggaguaccagaaaaccaagaacaaugacugggauuauguugugacaaccgacauuagcgagaugggcgccaacuucagagcugaucgcgugaucgacccccggagaugccugaaaccggucauucugaaggauggaccugaacgcgugauccucgccggccccaugcccguuacaguggccuccgcugcccagcggagagggcgcauuggacggaaucagaacaaagagggcgaccaauacgucuacauggggcagccucugaauaacgaugaagaccacgcgcauuggaccgaggcuaagaugcuucuggauaauaucaacacacccgagggaaucauuccugcccucuuugaaccggagagagaaaagucugccgcuaucgacggcgaguaucgccugagaggggaagcccggaaaaccuucguggagcugaugcgcagaggcgaucuccccguuuggcuuagcuacaagguggcguccgagggauuucaguauagcgaccggcgcuggugcuucgauggcgaaagaaauaaccagguccuggaggaaaauauggacguggagauuuggacgaaagaaggggagcggaagaaacugagaccucgcuggcucgacgcccggacauacucugauccccuggcucuuagagaguuuaaggaguucgccgcuggacgccgguccgucagcggcgaccugauccucgagauugggaaacugccucaacaccugacccucagagcccagaacgcucuugauaaucuggugaugcugcacaacuccgaacagggaggcaaggccuaucggcaugcgauggaggaacuccccgacaccaucgagacacugaugcuucuggcccucaucgcuguucugaccggcggggugacacuguuuuuccucucuggaaagggccuugggaaaacgagcauuggacugcugugugugaccgccuccucugcucuccuguggauggccagcgucgagccgcacuggaucgccgcuuccauuauccuugaauuuuuccugaugguucuccugauuccugagcccgaucgccagagaacaccucaagacaaucagcuggcguacguggugaucggccuccuuuuuaugauccugaccgucgccgcuaacgaaauggggcugcucgagacaaccaagaaagaucugggaauuggcuauguggccgccgagaaccaucagcacgcuacgaugcuugacguugaucugcggcccgccagcgcguggacccucuacgccguggcuacaaccgucaucacaccuaugaugcgccacaccauugaaaauacgacagccaacaucucucugaccgcuauugccaaucaagcggccauccugaugggccucgacaagggguggcccauuuccaaaauggauaucggagugccgcuucuggcucugggcugcuacagccaggucaacccucucacacugaccgccgcugugcuuaugcugguugcccauuaugcuaucauugggcccggacuccaggccaaggcgaccagagaggcccagaagcggacagcugccggcaucaugaaaaaucccacgguggacgggauugucgcuaucgaucuggacccugugguuuacgacgccaaguucgaaaaacaacugggacagauuaugcuccuuauccuguguaccucucagauccugcucaugcgcacaaccugggcccugugcgaguccauuacacuugcgaccggcccgcugacgacacucugggaaggcagccccgggaaguuuuggaacaccaccaucgcugugucuauggccaauauuuucagaggaagcuaucuggcuggcgccgggcuggccuucucccucaugaaaucucuuggaggcgggcggcgcggaacaggcgcucagggcgagacccugggggagaaguggaagagacaacugaaccagcucagcaaauccgaauuuaauacauacaagcggagcggaaucauggaggucgauagauccgaagccaaagagggccugaagcgcggggaaacgaccaaacacgcggugucucggggaacagccaaacuuagaugguucguggagcgcaaccugguuaagccugagggcaaagucauugaccucggguguggacggggcggcuggagcuauuacugcgcugggcugaagagagugaccgaagugaaaggauauacaaagggcgggcccggacaugaggaaccuauccccauggccaccuacggcuggaaucuggucaaacuccacuccgggaaggauguguuuuucaugccuccggagaaaugugacacgcuucugugcgauaucggagaaucuagccccaacccuaccauugaggagggccgcacacugcggguucucaagaugguggaacccuggcugaagggcaaucaguuuuguaucaaaauucuuaacccuuacaugcccuccgucguggagacccuggaacagaugcaaagaaagcaugggggaaugcucguucgcaauccgcugucucggaacagcacacacgagauguauuggguguccugcggcaccgggaauaucgucagcgcugugaacaugacaucuagaaugcugcucaaccgcuucaccauggcccaccggaaaccuacguacgagagagacguugaucugggagcgggcacacgccauguggccgucgaacccgagguggcuaaucuugacauuaucgggcagagaauugaaaacaucaagaaugagcacaaauccaccuggcauuaugaugaagacaaccccuacaagaccugggccuaucacggaagcuacgaggugaagccuucuggcuccgcuagcucuauggucaauggcguugugcggcugcucacaaaacccugggaugugaucccuauggucacgcagauugccaugaccgacacaaccccguuugggcaacagcgcguguucaaggagaaaguugacacaagaacaccccgggcuaagagaggaacaacccagaucauggaagugacggccaaauggcuguggggcuuucuuucccggaacaagaagccucgcauuuguaccagagaggaguucacacggaaaguccgcagcaaugcggccaucggggcuguguuuguugaugagaaccaguggaacuccgccaaggaagcuguggaggacgagagauucugggaucugguccaccgggaacgcgagcuccauaaacaaggaaagugcgcgaccugcguguauaacaugaugggcaaaagagaaaagaagcugggggaguuuggcaaagccaagggaagccgggcgauuugguacauguggcugggcgcucgcuuccucgaguucgaggcccugggguuuaugaaugaggaccacugguucucuagagaaaacagccuuuccggaguugagggcgaagggcugcauaaacucggauacauccugcgggauaucucuaagauucccggcgggaauauguaugccgacgauacagcuggcugggacacccgcaucacggaggaugaccuucagaacgaggccaaaauuacagauaucauggaaccugagcacgcucugcucgccaccagcauuuuuaagcugacauaccagaauaaaguggucagagugcagcggcccgcgaagaacggaaccgucauggacgugaucucccgcagagaucaacggggcucugggcagguuggaacguauggccugaacaccuucacaaauauggaagugcagcucaucagacagauggagagcgaagggauuuuucugccguccgagcuugagaccccuaaccuggccgaacgcguccucgacuggcuggagaagcauggagcugaacggcuuaaaagaauggccaucucuggcgacgauuguguggugaagcccauugacgaucgcuucgcuacagcccugaccgcgcucaaugacauggggaaaguucggaaggauaucccucaaugggagcccagcaaaggcuggaacgacuggcaacaggugccuuuuugcucccaccacuuccaucagcugauuaugaaggauggaagagaaaucgucgugcccugucgcaaucaagacgagcugguuggccgggccagagugagccagggggcuggauggucucuccgcgagacagccugccugggcaaguccuacgcucagauguggcaacuuauguauuuucaccggagagaucugcgccucgccgcuaacgccaucuguagcgcggucccgguggacugggucccuaccucucggacgacaugguccauucaugcccaccaccaguggaugaccaccgaagauaugcugagcguguggaauagaguuuggaucgaggaaaaccccuggauggaggacaaaacacauguguccucuugggaagagguccccuaccuugggaagcgggaggaccaguggugcggaagccugauuggccucaccgcuagagccacaugggccacgaauauccagguggcuauuaaccaaguucgccggcugaucgggaaugaaaacuaucuggauuacaugaccuccaugaaaagauucaagaaugagagcgacccugaaggcgcccucugguga

SEQ ID NO: 18505 - RNA, 9879 nt, Artificial Sequence
  derived and/or modified CDS sequence (opt5) from DENV-1__GU131863__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaaagcucgagggaaaaauugugcaguacgaaaaccugaaguauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagccccagaacaggccuugauuucaacgaaaugguccugcucaccaugaaagagaagucuuggcuggugcauaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcacaccgcucugacaggggccacggaaauucagaccagcggaacaaccacaaucuuugccggccaucuuaagugccgccugaaaauggacaagcucacccugaaagggauguccuaugucauguguacgggcagcuucaagcuggagaaggaaguggcugagacacagcacggaaccguucuugugcaggucaaauacgagggcaccgaugccccgugcaagauuccuuuccucacacaagacgaaaaaggggugacccagaacggaagacugaucacagcgaaucccaucgugacggauaaggagaaaccuguuaacauugaaaccgagccccccuuuggcgagucuuauaucgucgugggggcuggagaaaaggcccugaagcucuccugguucaaaaagggcagcucuauugggaaaauguuugaggccacagcucggggcgccagacgcauggcuauccugggagacaccgccugggauuucggcagcauugggggacuuuuuacauccgugggcaagcugauccaucaggucuucgggaccgcguacggagugcucuuuucuggcguuagcuggacgaugaaaaucgggauuggcauccugcugaccuggcuuggacucaauucccggagcacaucucuguccaugaccuguauugccgugggcauggucacacuguaccucggggugaugguucaggcugacagcggaugcgugaucaacuggaagggcagagaacugaagugugggucuggaauuuucgucaccaacgaggugcacacauggaccgaacaauauaaauuucaggccgauuccccuaagcgccuuagcgcugccaucggcaaagcgugggaggaggggguuugcggcauucgguccgccacgagacuggaaaauaucauguggaagcagaucucuaacgagcucaauuacauucugcuggaaaacgacaugaaauucacaguggucgugggagacaucaauggcauucuugcucaggggaagaaaaugauccgcccgcaacccauggagcauaaguauagcuggaaguccuggggaaaagccaagauuaucggcgcugauauccagaacaccaccuuuauuaucgacgggccugauacacccgaauguccugacgaucagcgggccuggaauauuugggagguggaggacuacggauucggcaucuuuaccacgaacauuuggcucaaacugagagauucucacacacagaugugcgaccaccgccugaugagcgccgcuaucaaggauuccaaagcgguccaugccgacaugggcuauuggaucgaaagcgagaagaaugaaaccuggaagcucgcucgggccucuuucauugagguuaaaacauguaucuggcccaagucccacacccuguggagcaacggggugcuugaaucugagauggugauuccgaaaaucuacggaggcccuauuucccaacauaauuauagacccggguacuucacacagaccgccggaccuuggcaccugggcaagcucgagcuggauuuugaccugugcgaagggacgaccgucgugguugaugagcacugcggauaccgcggccccagccuucggacaaccacagugaccggcaaaaucauccaugaaugguguugcagaucuuguacgcucccuccccugcgguuccgcggggaggacggaugcugguauggcauggagauuagaccggucaaggaaaaggaggaaaaccuggugcggagcaugguuuccgcugggagcggagagguggacucuuuuucccucggcauccugugugucagcauucuuaucgaagaggugaugagaucccgcuggucucggaaaaugcugaugacagggacccucgccguuuuccugcugcuuauuaugggacagcugacauggaaugaucucaucagacugugcauuauggugggcgcgaacgcuagcgaccgcaugggcauggggaccaccuaccucgcccugauggccacauuuaagaugagaccuauguucgcugucggacuucuguuucggcgccucacguccagagaggugcugcugcuuaccgugggccugucucucgucgccagcguugaacugcccaauucccucgaggaacugggggauggacuugcgaugggcaucaugaugcugaaacuccugacagacuuccaaccccaccagcuguggaccacacuucugucucucaccuuuauccggacgagccugucccucgauuaugcuuggaagacaauggccauggcccugagcauugugucucuuuucccucugugucuguccaccaccagccagaaaacaaccuggcucccggugcugcuugggucuuuuggaugcaagccccugacaauguuccucaucacggagaacaagauuuggggccgcaaauccuggccuaucaacgaaggcauuauggcugucgggaucgugagcauccugcucucuucccugcuuaagaaugacguuccccuggccggaccucugauugcuggcgggaugcucaucgccuguuacgugauuagcggauccagcgcggaucugucucuugagaaagccgcugaggucagcugggaagaggaagccgagcauuccggcaccucucacaacauccugguggaaguucaggacgaugggacaaugaagauuaaagacgaggagagagaugacacccucacaauccugcucaaggcuacccugcuugccgugagcggagucuaucccauguccaucccugccacgcuguuugugugguacuucuggcaaaaaaagaagcagcggucuggcguccugugggauacccccagcccgccugaaguggagcgcgcuguucucgacgacggcauuuauagaauccugcagcgggggcuucugggacgcucccaggugggcgucgggguguuccaagauggaguuuuucauacaauguggcacgugaccagaggcgcgguccucauguaccaggggaaacggcuggaacccucuugggccagcgugaagaaagaccucauuuccuacggaggcggcuggagauuccaggggagcuggaauacaggagaggaggugcagguuaucgcugucgaaccuggcaagaaccccaaaaaugugcaaaccacaccggggacguuuaagaccccugagggagaagugggcgccauugcccuggauuucaagcccgggacaucuggauccccuaucgucaaccgcgagggcaaaauugugggccuuuaugggaauggaguugugaccaccagcggcacauacgucucugcuaucgcccaggcgaaggcuacgcaggaagggccccugcccgagaucgaggacgaaguguuuaaaaagcggaaccugaccauuauggaucuccacccuggauccggcaaaacaagacgcuaucugccggccaucguucgggaggccauuaagagaaagcuucgcacccugauccucgcucccacacggguggucgccagcgaaauggcggaggcucugaaagggaugccuauuagauaccaaaccacggccgugaaguccgaacauacaggccgcgagaucguugaccugaugugccacgccaccuucaccaugcggcuccuuucucccgugagagucccuaauuauaacaugaucauuauggaugaggcucauuuuacagaccccgccagcaucgcugcccggggauacauuuccacccgcgugggcaugggggaagcggccgcuaucuucaugacagccaccccuccgggaagcguggaggcuuuuccccagucuaaugccgucauucaggaugaagagagagacaucccugaacgguccuggaacagcggcuaugauuggaucacggacuuccccgggaaaacaguuugguuugugccuucuauuaagagcggaaaugacaucgccaacugucugcgcaaaaauggcaagagagugauucagcugucccggaagaccuucgauacagaguaccaaaaaaccaagaacaacgacugggauuacgucgugacgaccgacaucucugagaugggggcuaauuucagagcggaucgcguuauugacccccggagaugccucaaaccggugauccugaaggaaggcccugagcgcgucauucuugccggacccaugcccgugacaguugcuagcgccgcccagcggagaggccgcaucgggcggaaccagaauaaagaaggagaucaguauaucuacaugggccaaccucugaacaaugacgaggaucacgcucauuggaccgaggccaagaugcuccuggacaacauuaauacacccgaagggaucauuccugcgcuguuugagccggaaagagagaaguccgcugccaucgauggagaauaucgccucagaggcgaggcccggaaaaccuucguggagcuuaugcgcagaggggaccugcccgucuggcugucuuacaagguggcuagcgaaggcuuucaguauuccgaucggcgcuggugcuucgacggagagagaaacaaucagguccucgaagagaacauggacguggaaauuuggacaaaagagggcgagcggaagaaacugagaccucgcuggcuugaugcccggaccuacagcgacccccuggcgcucagagaauuuaaggaguucgccgcugggcgccggucuguuuccggagaucugauccuggaaaucggcaaacucccucagcaccuuacgcugagagcccaaaaugcucuggacaaccucgugaugcugcacaauagcgagcaggggggaaaggccuaucggcaugcuauggaagagcuucccgauacaauugagacccugaugcuccuggcccugaucgcggugcucaccggcggcgucacacuuuuuuuccuguccgggaagggacugggcaaaaccucuauugggcuccuguguguuauggccagcuccgcucuucuguggauggccucuguggaaccgcacuggaucgcugccagcauuauccucgaguuuuuccugauggugcugcucaucccugaacccgaccgccagagaacaccucaggauaaccaacuugccuacgucgugauuggacugcuguuuaugauccucacgguugcugcgaaugagaugggccugcuugagaccacaaagaaagaccuggggauuggacauguggccgucgaaaaccaccaccaugcuaccaugcucgauguggaccugcggcccgccuccgccuggacacuguacgcugucgccaccacggugaucaccccuaugaugcgccacacaauugagaacaccacagcgaauaucagccucaccgccauugcuaaccaggccgcuauccuuaugggccuggauaagggcuggcccaucucuaaaauggacauugggguuccgcugcucgcccugggaugcuauucccaggugaauccucuuacgcugacagcggccguccucaugcugguggcucauuacgccaucauuggccccgggcugcaagcuaaggccaccagagaagcucagaagcggacagccgcgggaaucaugaaaaaccccaccguugauggcauugugaccaucgaccucgacccugucguguaugaugccaaguucgagaaacagcuugggcagaucaugcugcugauucucuguacaagccaaauccugcuuaugcgcacgaccugggcucugugcgaaucuauuacacucgccaccggaccgcugacaacccugugggagggcucccccggcaaguuuuggaauacgacaaucgcugugagcauggccaacauuuucagagggucuuaccucgccggagcgggccuugcuuucagccugaugaaaucccuggggggaggccggcgcgggaccggagcccagggcgagacccucggcgaaaaguggaagagacagcugaaucagcuuucuaaaagcgaguuuaacacauauaagaaauccgggaucauggaaguugaccggagcgaggcuaaggaaggacugaaaagaggcgagaccacaaagcacgccgucucccgcgggacggccaagcuccggugguucguggagagaaaucuggugaaaccugaaggaaaggucaucgaucugggcugugggcgcggaggcuggucuuacuauugcgcuggccucaaaaagguuaccgaggugaaaggguacacaaagggaggccccgggcaugaagagccuauucccauggccaccuacggauggaaccuugugaaacugcacagcggcaaggacgucuuuuucacaccuccggaaaagugugauacccugcucugcgacaucggggaguccucucccaauccuacgauugaggaaggacggacccugagagugcuuaaaaugguugagcccuggcugcgcggcaaccaauuuuguaucaagauucucaauccuuauaugcccagcguggucgaaacacuggagcagaugcagcggaaacacggcgggaugcuggugagaaacccgcucucccgcaauucuacccaugagauguacuggguuagcugcggaacaggcaacaucguguccgcggucaauaugaccagccggaugcugcuuaacagauucacaauggcccaccgcaagccuaccuaugaacgggauguggaccugggggcuggaacgagacauguggccgucgagcccgaaguugcuaaccucgauauuaucggccagcgcaucgagaauauuaaaaacgaacacaagucuacauggcacuacgacgaggauaaucccuauaagaccugggccuaccauggguccuaugaggugaaaccuagcggaucugcguccagcauggugaacggcgucgugagacugcuuaccaagcccugggacguuaucccuauggugacacaaauugccaugacggacaccacaccguuuggccagcagcgggucuucaaagaaaagguggauacccgcacacccagagcuaaacgggggaccgcccaaaucauggagguuacagcuaaguggcuguggggauuucucucuagaaauaagaaaccucggauuuguacccgcgaagaguucacgagaaaggugcgguccaacgccgcuaucggcgccgucuuuguggacgaaaaucaguggaacagcgcgaaagaggccguugaggaugaacgcuucugggaccuggugcacagagagcgggaacugcauaagcaggggaaaugcgcuaccugcgucuacaauaugaugggaaagcgcgagaagaaacucggcgaauuugggaaggccaaaggcuccagagcuaucugguacauguggcugggagcccgguuccuugaguucgaggcccugggcuuuaugaacgaagaucacugguucagccgcgagaauucucucagcgggguggaaggagagggccugcauaagcuuggguauauucugagagacaucuccaaaauucccggaggcaacauguacgcggaugacacagcugggugggauacccggaucacagaggacgaucuccagaaugaagccaagauuaccgacaucauggagccugaacacgcccugcuggcuacgucuaucuuuaaacucacauaucaaaacaaggucgugcgcguucagagacccgccaagagcggcaccgugauggaugucauuucccggcgcgaccagagaggaucuggccagguggggacauacggacugaauaccuucacgaacauggaggugcaacuuauccggcagauggaaagcgagggcauuuuuuccccgucugagcuggaaaccccuaaccucgcuaaaaagguucuggacuggcuugagaaacacggggccgaaagacugaagcgcauggcgaucagcggagaugacuguguggucaaacccauugaugaccgguucgccacagcucucaccgcccugaaugauaugggcaaggugagaaaggacaucccucagugggagcccuccaaaggguggaacgauuggcagcaaguuccuuuuugcagccaucacuuccaucagcugaucaugaaggacggccgcgaaauugugguccccugucggaaucaggaugagcucgugggaagagcucgcgucucucagggcgccggguggucccugcgggagacagcgugccuuggaaaaagcuaugcccaaauguggcagcugauguacuuucacagacgcgaccuccggcuggcugccaacgcuaucuguucugccgugccgguugauugggugccuaccuccagaacaaccuggagcauucacgcucaucaccaguggaugacgacagaagacaugcuuuccgucuggaaucgcguguggaucgaggaaaaccccuggauggaggacaagacccauguuucuagcugggaagaggugcccuaucugggcaaacgggaggaucaauggugcgggucccucauuggacugaccgccagagcgacaugggccaccaauauccaggucgcuauuaaccaggugcggagacugaucggcaaugaaaacuaccucgacuacaugacaagcaugaagcgcuucaagaaugagucugauccugaaggggcccugugguga

SEQ ID NO: 18506 - RNA, 9879 nt, Artificial Sequence
  derived and/or modified CDS sequence (opt5) from DENV-1__GQ868559__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaucuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaccagcuguggacaacccuccugagccugacguuuguuaaaacaacccuuucccuggauuacgccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuaucgccgggggaaugcugaucgcguguuaugugauuagcggcuccagcgccgaucugucucucgagaaagcugccgaagucagcugggagcaggaagcugagcauuccggggccucucacaauauccugguggaaguucaagacgauggaacaaugaagauuaaagacgaggagagagaugacacccuuacgauccugcucaaggccacccugcucgcugugagcggcgucuaccccauguccauuccugcgacacuguuugugugguauuucuggcagaaaaagaagcagcggucuggcguccuuugggauacccccagcccgccugaaguggagcgcgccguucuggacgaugggaucuacagaauccugcagcggggacuccugggccgcucccaagugggggucggaguguuccaggacggcguuuuucauacaauguggcacgugaccagaggggcuguccuuauguaucagggaaaacggcuggaacccucuugggccagcgugaagaaagaccucauuuccuacggcggcggguggagauuccagggaagcuggaacacaggcgaggaggugcaaguuaucgccgucgaaccugggaagaaucccaaaaacgugcagacgaccccgggaacauuuaagaccccugagggcgaagugggggcuauugcccuggauuucaagcccggaaccucuggcuccccuaucgucaaucgcgagggcaaaauuguggggcucuacggaaacggcguugugacaacgagcgggaccuaugucucugcgaucgcucaggccaaggccucccaagaaggaccccugcccgagauugaggacgaaguguuuaaaaagcggaaucuuacaaucauggaucugcacccuggcagcgggaaaaccagacgcuaccugccggcuaucguucgggaggccauuaagagaaagcuccgcacacugauccuugcgcccacccggguggucgcuuccgaaauggccgaggcccugaaaggcaugccuauuagauaucagacgacagcugugaagucugaacauaccggacgcgagaucguugaccucaugugccacgccaccuucacaaugcggcugcugagccccgugagagucccuaacuacaauaugauuaucauggaugaggcucauuuuaccgaccccgccuccaucgcggcccggggcuauauuagcacacgcguggggaugggagaagcugccgcuaucuucaugaccgccacgccuccgggcucuguggaggccuuuccccaguccaacgcugucauucaggaugaagagagagacaucccugaacggagcuggaauucuggguacgauuggauuacagacuuccccggaaaaaccguuugguuugugccuagcaucaaguccggcaacgauaucgcgaauugucuccgcaaaaacgggaagagagugauucaacuuucucggaagacauucgacaccgaguaucagaaaacgaagaacaaugacugggauuacgucgugaccacagacaucagcgagaugggcgccaacuucagagcugaucgcguuauugacccccggagaugccugaaaccggugauccugaaggauggaccugaacgcgucauucucgccggccccaugcccgugaccguugccuccgcugcccagcggagagggcgcaucggacggaaucagaacaaagagggcgaccaauacguguauauggggcagccucugaauaacgaugaagaccacgcgcauuggacagaggcuaagaugcuucuggauaauauuaacacccccgagggaaucaucccugcccucuuugaaccggagagagaaaagucugccgcuauugacggcgaguaccgccugagaggggaagcccggaaaacauucgucgagcugaugcgcagaggcgaucuccccguguggcuuagcuauaaggucgcguccgagggauuucaguacagcgaccggcgcuggugcuucgauggcgaaagaaauaaccaggugcuggaggaaaauauggacguugagaucuggaccaaagaaggggagcggaagaaacugagaccucgcuggcucgacgcccggacguauucugauccccuggcucuuagagaguuuaaggaauucgccgcuggacgccgguccgugagcggcgaccugauucucgagaucgggaaacugccucaacaccugacacucagagcccagaacgcucuugauaaucuggugaugcugcacaacuccgaacagggaggcaaggccuaccggcaugcgauggaggaacuccccgacaccauugagacccugaugcuucuggcccucaucgcuguccugacaggcgggguuacccuguuuuuccucucuggaaagggccuugggaaaacaagcaucggacugcugugugugacggccuccucugcucuccuguggauggccagcguggagccgcacuggauugccgcuuccaucauucuugaauuuuuccugaugguccuccugaucccugagcccgaucgccagagaaccccucaagacaaucagcuggcguaugugguuauuggccuccuuuuuaugauccugacaguggccgcuaacgaaauggggcugcucgagaccacaaagaaagaucugggaaucggcuacgucgccgccgagaaccaucagcacgcuaccaugcuugacguggaucugcggcccgccagcgcguggacgcucuacgccgucgcuaccacagugauuaccccuaugaugcgccacacaaucgaaaauaccacggccaacauuucucugacagcuaucgccaaucaagcggccauucugaugggccucgacaagggguggcccaucuccaaaauggauauuggaguuccgcuucuggcucugggcugcuauagccaggugaacccucucacccugacagccgcuguccuuaugcugguggcccauuacgcuaucaucgggcccggacuccaggccaaggcgaccagagaggcccagaagcggaccgcugccggcauuaugaaaaaucccacaguugacgggaucguggcuauugaucuggacccugucguguaugacgccaaguucgaaaaacaacugggacagaucaugcuccuuauucuguguacgucucagauccugcucaugcgcaccacaugggcccugugcgaguccaucacccuugcgacaggcccgcugaccacgcucugggaaggcagccccgggaaguuuuggaacacaaccauugcugugucuauggccaauaucuucagaggaagcuaccuggcuggcgccgggcuggccuucucccucaugaaaucucuuggaggcgggcggcgcggaaccggcgcucagggcgagacacugggggagaaguggaagagacaacugaaccagcucagcaaauccgaauuuaauaccuauaagcggagcggaauuauggagguugauagauccgaagccaaagagggccugaagcgcggggaaacaacgaaacacgcggucucucggggaaccgccaagcuuagaugguucguggagcgcaaccuggugaagccugagggcaaagucaucgaccucggguguggacggggcggcuggagcuacuauugcgcugggcugaagaaaguuacagaagugaagggauacaccaaaggcgggcccggacaugaggaaccuauucccauggccacauacggcuggaaucuggugaagcuccacuccgggaaagaugucuuuuucaugccuccggagaagugugacacccuucugugcgauaucggagaaucuagccccaacccuacgaucgaggagggcagaacccugcgcgugcucaagaugguugaacccuggcugcggggcaaucaguuuuguauuaaaauccuuaacccuuauaugcccuccguggucgagacacuggaacagaugcaaagaaagcaugggggaaugcucgugcgcaauccgcugucucggaacagcacccacgagauguacuggguuuccugcggcacagggaauauugugagcgcugucaacaugaccucuagaaugcugcucaaccgcuucacaauggcccaccggaaaccuaccuaugagagagacguggaucugggagcgggcacgcgccauguggccgucgaacccgaggaagcuaaucuugacaucauugggcagagaaucgagaacauuaagaaugaacacaaauccacauggcauuacgaugaggacaaccccuauaagaccugggccuaccacggaagcuaugagguuaagccuucuggcuccgcuagcucuauggugaauggcgugguccggcugcucaccaaacccugggaugugaucccuaugguuacacagaucgccaugacggacaccacaccguuugggcaacagcgcguguucaaggaaaaagucgacaccagaacaccccgggcuaagagaggaaccacacagauuauggaggugaccgccaaauggcuguggggcuuucuuucccggaacaagaagccucgcaucuguacgagagaagaguucacccggaaaguucgcagcaaugcggccauuggggcuguguuugucgaugaaaaccaguggaauuccgccaaggaggcuguggaggacgaaagauucugggaucugguucaccgggagcgcgaacuccauaaacaaggaaagugcgccacaugcguguacaacaugaugggcaaaagagagaagaagcugggggaauuuggcaaagccaagggaagccgggcgaucugguacauguggcugggcgcucgcuuccucgaguucgaggcccugggguuuaugaaugaagaccacugguucucuagagagaacagccuuuccggagucgaaggcgaggggcugcauaaacucggauauauucugcgggauaucucuaagauccccggcgggaauauguacgccgacgauaccgcuggcugggacacacgcauuaccgaggaugaccuucagaacgaagccaaaaucacggauauuauggagccugaacacgcucugcucgccacaagcaucuuuaagcugaccuaucagaauaaaguggucagagugcagcggcccgcgaagaacggaacaguuauggacgugauuucccgcagagaucaacggggcucugggcaggucggaaccuacggccugaacacguucaccaauauggaggugcagcucaucagacagauggaaagcgaggggaucuuucugccguccgagcuugaaacaccuaaccuggccgagcgcgugcucgacuggcuggaaaagcauggagcugagcggcuuaaaagaauggccauuucuggcgacgauuguguugugaagcccaucgacgaucgcuucgcuaccgcccugacagcgcucaaugacauggggaaaguccggaaggauauuccucaaugggaacccagcaaaggcuggaacgacuggcagcaggugccuuuuugcucccaccacuuccaucagcugaucaugaaggauggaagagagauuguugugcccugucgcaaucaagacgagcuggucggccgggccagagugagccagggggcuggauggucucuccgcgaaaccgccugccugggcaaguccuaugcucagauguggcaacuuauguacuuucaccggagagaucugcgccucgccgcuaacgccaucuguagcgcggucccgguggacuggguuccuacaucucggaccacgugguccauccaugcccaccaccaguggaugacaaccgaggauaugcugagcguguggaauagagucuggauugaagagaaccccuggauggaagacaaaacccauguguccucuugggaggagguucccuaucuugggaagcgggaagaccaguggugcggaagccugaucggccucacagcuagagccaccugggccacaaauauucagguggcuaucaaccaaguccgccggcugauugggaaugagaacuaccuggauuacaugacguccaugaaaagauucaagaaugaaagcgacccugagggcgcccucugguga

SEQ ID NO: 18507 - RNA, 9879 nt, Artificial Sequence
  derived and/or modified CDS sequence (opt5) from DENV-1__GQ868560__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaucuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaccagcuguggacaacccuccugagccugacguuuguuaaaacaacccuuucccuggauuacgccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuaucgccgggggaaugcugaucgcguguuaugugauuagcggcuccagcgccgaucugucucucgagaaagcugccgaagucagcugggagcaggaagcugagcauuccggggccucucacaauauccugguggaaguucaagacgauggaacaaugaagauuaaagacgaggagagagaugacacccuuacgauccugcucaaggccacccugcucgcugugagcggcgucuaccccauguccauuccugcgacacuguuugugugguauuucuggcagaaaaagaagcagcggucuggcguccuuugggauacccccagcccgccugaaguggagcgcgccguucuggacgaugggaucuacagaauccugcagcggggacuccugggccgcucccaagugggggucggaguguuccaggacggcguuuuucauacaauguggcacgugaccagaggggcuguccuuauguaucagggaaaacggcuggaacccucuugggccagcauuaagaaagaccucaucuccuacggcggcggguggagauuccagggaagcuggaacacaggcgaggaggugcaagugauugccguugaaccugggaagaaucccaaaaacguccagacgaccccgggaacauuuaagaccccugagggcgaagugggggcuaucgcccuggauuucaagcccggaaccucuggcuccccuauugugaaucgcgagggcaaaaucgucgggcucuacggaaacggcgugguuacaacgagcgggaccuaugugucugcgauugcucaggccaaggccucccaagaaggaccccugcccgagaucgaggacgaagucuuuaaaaagcggaaucuuacaaucauggaucugcacccuggcagcgggaaaaccagacgcuaccugccggcuauugugcgggaggccaucaagagaaagcuccgcacacugauucuugcgcccacccggguuguggcuuccgaaauggccgaggcccugaaaggcaugccuaucagauaucagacgacagcugucaagucugaacauaccggacgcgagauuguggaccucaugugccacgccaccuucacaaugcggcugcugagccccguuagagugccuaacuacaauaugaucaucauggaugaggcucauuuuaccgaccccgccuccauugcggcccggggcuauaucagcacacgcgucgggaugggagaagcugccgcuauuuucaugaccgccacgccuccgggcucuguggaggccuuuccccaguccaacgcugugauccaggaugaagagagagacauuccugaacggagcuggaauucuggguacgauuggaucacagacuuccccggaaaaaccgucugguuuguuccuagcaucaaguccggcaacgauauugcgaauugucuccgcaaaaacgggaagagagugauccaacuuucucggaagacauucgacaccgaguaucagaaaacgaagaacaaugacugggauuacguggucaccacagacauuagcgagaugggcgccaacuucagagcugaucgcgugaucgacccccggagaugccugaaaccgguuauucugaaggauggaccugaacgcgugauccucgccggccccaugcccgucaccguggccuccgcugcccagcggagagggcgcauuggacggaaucagaacaaagagggcgaccaauacguuuauauggggcagccucugaauaacgaugaagaccacgcgcauuggacagaggcuaagaugcuucuggauaauaucaacacccccgagggaaucauuccugcccucuuugaaccggagagagaaaagucugccgcuaucgacggcgaguaccgccugagaggggaagcccggaaaacauucguggagcugaugcgcagaggcgaucuccccgucuggcuuagcuauaagguggcguccgagggauuucaguacagcgaccggcgcuggugcuucgauggcgaaagaaauaaccagguccuggaggaaaauauggacguggagauuuggaccaaagaaggggagcggaagaaacugagaccucgcuggcucgacgcccggacguauucugauccccuggcucuuagagaguuuaaggaauucgccgcuggacgccgguccguuagcggcgaccugauccucgagauugggaaacugccucaacaccugacacucagagcccagaacgcucuugauaaucuggugaugcugcacaacuccgaacagggaggcaaggccuaccggcaugcgauggaggaacuccccgacaccaucgagacccugaugcuucuggcccucaucgcugugcugacaggcggggucacccuguuuuuccucucuggaaagggccuugggaaaacaagcauuggacugcuguguguuacggccuccucugcucuccuguggauggccagcguggagccgcacuggaucgccgcuuccauuauccuugaauuuuuccugauggugcuccugauuccugagcccgaucgccagagaaccccucaagacaaucagcuggcguaugucgugaucggccuccuuuuuaugauccugacaguugccgcuaacgaaauggggcugcucgagaccacaaagaaagaucugggaauuggcuacguggccgccgagaaccaucagcacgcuaccaugcuugacgucgaucugcggcccgccagcgcguggacgcucuacgccguggcuaccacagucaucaccccuaugaugcgccacacaauugaaaauaccacggccaacaucucucugacagcuauugccaaucaagcggccauccugaugggccucgacaagggguggcccauuuccaaaauggauaucggagugccgcuucuggcucugggcugcuauagccagguuaacccucucacccugacagccgcugugcuuaugcuggucgcccauuacgcuaucauugggcccggacuccaggccaaggcgaccagagaggcccagaagcggaccgcugccggcaucaugaaaaaucccacaguggacgggauuguugcuaucgaucuggacccuguggucuaugacgccaaguucgaaaaacaacugggacagauuaugcuccuuauccuguguacgucucagauccugcucaugcgcaccacaugggcccugugcgaguccauuacccuugcgacaggcccgcugaccacgcucugggaaggcagccccgggaaguuuuggaacacaaccaucgcugugucuauggccaauauuuucagaggaagcuaccuggcuggcgccgggcuggccuucucccucaugaaaucucuuggaggcgggcggcgcggaaccggcgcucagggcgagacacugggggagaaguggaagagacaacugaaccagcucagcaaauccgaauuuaauaccuauaagcggagcggaaucauggagguggauagauccgaagccaaagagggccugaagcgcggggaaacaacgaaacacgcgguuucucggggaaccgccaagcuuagaugguucgucgagcgcaaccuggugaagccugagggcaaagugauugaccucggguguggacggggcggcuggagcuacuauugcgcugggcugaagaaagucacagaaguuaagggauacaccaaaggcgggcccggacaugaggaaccuauccccauggccacauacggcuggaaucuggugaagcuccacuccgggaaagauguguuuuucaugccuccggagaagugugacacccuucugugcgauaucggagaaucuagccccaacccuacgauugaggagggcagaacccugcgcguccucaagaugguggaacccuggcugcggggcaaucaguuuuguaucaaaauucuuaacccuuauaugcccuccguuguggagacacuggaacagaugcaaagaaagcaugggggaaugcucguccgcaauccgcugucucggaacagcacccacgagauguacuggguguccugcggcacagggaauaucguuagcgcugugaacaugaccucuagaaugcugcucaaccgcuucacaauggcccaccggaaaccuaccuaugagagagacgucgaucugggagcgggcacgcgccauguggccguggaacccgaggaagcuaaucuugacauuaucgggcagagaauugagaacaucaagaaugaacacaaauccacauggcauuacgaugaggacaaccccuauaagaccugggccuaccacggaagcuaugaggucaagccuucuggcuccgcuagcucuaugguuaauggcguggugcggcugcucaccaaacccugggaugucaucccuauggugacacagauugccaugacggacaccacaccguuugggcaacagcgcguuuucaaggaaaaaguggacaccagaacaccccgggcuaagagaggaaccacacagaucauggaggucaccgccaaauggcuguggggcuuucuuucccggaacaagaagccucgcauuuguacgagagaagaguucacccggaaagugcgcagcaaugcggccaucggggcuguuuuuguggaugaaaaccaguggaauuccgccaaggaggcugucgaggacgaaagauucugggaucuggugcaccgggagcgcgaacuccauaaacaaggaaagugcgccacaugcguuuacaacaugaugggcaaaagagagaagaagcugggggaauuuggcaaagccaagggaagccgggcgauuugguacauguggcugggcgcucgcuuccucgaguucgaggcccugggguuuaugaaugaagaccacugguucucuagagagaacagccuuuccggaguggaaggcgaggggcugcauaaacucggauauauccugcgggauaucucuaagauucccggcgggaauauguacgccgacgauaccgcuggcugggacacacgcaucaccgaggaugaccuucagaacgaagccaaaauuacggauaucauggagccugaacacgcucugcucgccacaagcauuuuuaagcugaccuaucagaauaaagucgugagaguccagcggcccgcgaagaacggaacagugauggacguuaucucccgcagagaucaacggggcucugggcaggugggaaccuacggccugaacacguucaccaauauggagguccagcucaucagacagauggaaagcgaggggauuuuucugccguccgagcuugaaacaccuaaccuggccgagcgcgugcucgacuggcuggaaaagcauggagcugagcggcuuaaaagaauggccaucucuggcgacgauugugugguuaagcccauugacgaucgcuucgcuaccgcccugacagcgcucaaugacauggggaaagugcggaaggauaucccucaaugggaacccagcaaaggcuggaacgacuggcagcaggucccuuuuugcucccaccacuuccaucagcugauuaugaaggauggaagagagaucgugguucccugucgcaaucaagacgagcuggugggccgggccagagucagccagggggcuggauggucucuccgcgaaaccgccugccugggcaaguccuaugcucagauguggcaacuuauguacuuucaccggagagaucugcgccucgccgcuaacgccaucuguagcgcggugccggucgacugggugccuacaucucggaccacgugguccauucaugcccaccaccaguggaugacaaccgaggauaugcugagcguuuggaauagaguguggaucgaagagaaccccuggauggaagacaaaacccaugucuccucuugggaggaggugcccuaucuugggaagcgggaagaccaguggugcggaagccugauuggccucacagcuagagccaccugggccacaaauauccagguugcuauuaaccaagugcgccggcugaucgggaaugagaacuacauugauuacaugacguccaugaaaagauucaagaaugaaagcgacccugagggcgcccugugguga

SEQ ID NO: 18508 - RNA, 9879 nt, Artificial Sequence
  derived and/or modified CDS sequence (opt5) from DENV-1__GQ868561__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggauuucguugagggacuguccggcgccacauggguggacgucgugcucgagcacgggagcugugugacgaccauggcuaagaauaaacccacacuggauaucgaacugcucaagaccgaggucacaaacccugccguucugcgcaaacuuugcauugaagcgaagaucucuaauaccacgacagacuccagauguccgacccaaggagaggccacccugguggaagagcaggaugcuaacuuugugugccggcgcacauucgucgacagaggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucagcaucaaguugggaaugagacaaccgaacacggaacaaucgcuaccauuacgccccaggccccuaccuccgagauccagcugacagacuacggcgcccugacccucgacuguagcccccggacaggccuggauuuuaacgaaauggugcuucugaccaugaaggagaaaucuuggcucguccauaagcagugguuccuggaccuuccucugcccuggacguccggggcuagcacaucccaagagaccuggaaucgccaggaucuccuggugacauuuaaaaccgcgcacgccaagaagcaggaagucgugguucugggaucucaagagggcgcuaugcacaccgcccucacaggggccacggaaauucagaccagcggaacaaccacaaucuucgcuggccaucugaaaugcagacuuaagauggacaaacugacccucaaggggauguccuaugugauguguacgggcagcuucaaacuggagaaggaagucgccgagacacagcacggaaccgugcugguucaggugaaguacgagggcaccgaugcgccgugcaaaauuccuuuuucuacacaagacgaaaagggggucacccagaacggacggcuuaucacagcuaaucccaucgugacggauaaagagaagccugugaacauugaaaccgagccccccuucggcgaguccuauaucguugucggggccggagaaaaagcccucaagcugagcugguuuaagaaaggcucuagcauugggaagauguucgaggcuacagccagaggcgcucgccggauggccauccugggagacaccgcgugggauuuuggcuccauugggggaguguucacaucugugggcaaacucguccaucagguguuugggaccgccuacggaguucuguucagcggcguguccuggacgaugaagaucgggaucggcauucuucugaccuggcucggacugaauagcagaucuacaucccugagcaugaccuguaucgcugucggcauggugacacuuuaccucgggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcuguccgccgcgauuggcaaggccugggaggagggggugugcggcaucagaucugcuacgcgccucgaaaauauuauguggaaacagaucagcaacgagcugaaucauauccuucuggaaaacgacaugaaguuuacagucguggugggagacgccaauggcauucucgcucaggggaaaaagaugauccggccgcaacccauggagcacaaauacuccuggaagucuuggggaaaggccaaaauuaucggcgccgauauucagaacaccaccuucaucaucgacgggccugauacacccgaauguccugacggacagagagcuuggaauauuugggaggucgaggauuauggcuuuggcaucuucaccacgaacauuuggcugaagcugcgcgacagcuacacacagaugugcgaucaccggcuuauguccgcggccaucaaagacagcaaggcuguucaugccgauaugggguauuggauugaaucugagaaaaaugaaaccuggaagcucgccagagcuuccuucaucgaggugaagacauguaccuggcccaaaagccacacacuguggucuaacggagugcuggaauccgagaugaucauuccgaagaucuacggcgggccuauuagccaacauaauuaucgccccggauacuuuacccagacggccggcccuuggcaccucgggaaacuggagcuugacuucgaucugugcgaaggaaccacagucgugguugacgagcacugcggcaaccggggccccucucucagaaccacaaccgugacggggaagaucauucaugaaugguguugccggagcuguacacugccuccccugcgcuuuagaggagaggauggcugcugguacgggauggagauccggccggucaaagaaaaggaggaaaaucuugugagauccaugguuagcgcgggaucuggcgagguggacuccuucagccucgggauccugugugucuccauuaugaucgaagaggugaugcgcucucgguggagcagaaagaugcugaugaccggaacacucgcuguuuuucugcuucugauuaugggccagcucaccuggaacgaccugauccgccugugcauuauggugggcgccaaugccuccgauagaauggggaugggaaccacauaucuugcucugauggccacguucaaaaugcggccuauguuugcggucggccuccuguuccgcagacucaccucucgggaggugcugcuucugacaaucgggcucagccugguggcuuccgucgaacugcccaacucucuugaggaacugggagacggccucgccauggggauuaugaugcugaagcuccugaccgaguuucaaccccaccagcuuuggacaacccugcucagccugacguucguuaaaacaacccugucccuugauuacgccuggaagaccacagcuauggugcugagcaucgugucucucuuuccucugugucucuccaccacaagccagaaaacgaccuggcugccgguccuucugggaucuuucggcugcaagccccugacaauguuucucaucaccgaaaacaagauuuggggccgcaaauccuggccucugaaugaggggaucauggccauuggaaucgugagcauucuucugucuucccuccugaagaacgacguuccccucgcuggcccucugaucgccgggggaaugcuuaucgcguguuaugugauuagcggcuccagcgccgaucugucucuggagaaagcugccgaagucagcugggagcaggaagcugagcauuccggggccucucacaauauccucguggaaguucaagacgauggaacaaugaagauuaaagacgaggagagagaugacacccugacgauccuucugaaggccacccuccuggcugugagcggcgucuaccccauguccauuccugcgacacucuucgugugguauuucuggcagaaaaagaagcagcggucuggcguccugugggauacccccagcccgccugaaguggagcgcgccguucuugacgaugggaucuacagaauccugcagcggggacugcucggccgcucccaagugggggucggaguguuucaggacggcguuuuccauacaauguggcacgugaccagaggggcuguccugauguaucagggaaaacggcuugaacccucuugggccagcgugaagaaagaccugauuuccuacggcggcggguggagauuucagggaagcuggaacacaggcgaggaggugcaaguuaucgccgucgaaccugggaagaaucccaaaaacgugcagacgaccccgggaacauucaagaccccugagggcgaagugggggcuauugcccucgauuuuaagcccggaaccucuggcuccccuaucgucaaucgcgagggcaaaauuguggggcuguacggaaacggcguugugacaacgagcgggaccuaugucucugcgaucgcucaggccaaggccucccaagaaggaccccuccccgagauugaggacgaaguguucaaaaagcggaaucugacaaucauggaucuucacccuggcagcgggaaaaccagacgcuaccugccggcuaucguucgggaggccauuaagagaaagcugcgcacacucauccuggcgcccacccggguggucgcuuccgaaauggccgaggcccuuaaaggcaugccuauuagauaucagacgacagcugugaagucugaacauaccggacgcgagaucguugaccugaugugccacgccaccuuuacaaugcggcuccugagccccgugagagucccuaacuacaauaugauuaucauggaugaggcucauuucaccgaccccgccuccaucgcggcccggggcuauauuagcacacgcguggggaugggagaagcugccgcuaucuuuaugaccgccacgccuccgggcucuguggaggccuucccccaguccaacgcugucauucaggaugaagagagagacaucccugaacggagcuggaauucuggguacgauuggauuacagacuuucccggaaaaaccguuugguucgugccuagcaucaaguccggcaacgauaucgcgaauugucugcgcaaaaacgggaagagagugauucaacucucucggaagacauucgacaccgaguaucagaaaacgaagaacaaugacugggauuacgucgugaccacagacaucagcgagaugggcgccaacuuuagagcugaucgcguuauugacccccggagaugccuuaaaccggugauccugaaggauggaccugaacgcgucauucuggccggccccaugcccgugaccguugccuccgcugcccagcggagagggcgcaucggacggaaucagaacaaagagggcgaccaauacguguauauggggcagccucucaauaacgaugaagaccacgcgcauuggacagaggcuaagaugcugcuugauaauauuaacacccccgagggaaucaucccugcccuguucgaaccggagagagaaaagucugccgcuauugacggcgaguaccgccucagaggggaagcccggaaaacauuugucgagcugaugcgcagaggcgaucugcccguguggcucagcuauaaggucgcguccgagggauuccaguacagcgaccggcgcuggugcuuugauggcgaaagaaauaaccaggugcuugaggaaaauauggacguugagaucuggaccaaagaaggggagcggaagaaacugagaccucgcuggcuggacgcccggacguauucugauccccucgcucugagagaguucaaggaauuugccgcuggacgccgguccgugagcggcgaccuuauucuggagaucgggaaacucccucaacaccugacacugagagcccagaacgcucucgauaaucuugugaugcugcacaacuccgaacagggaggcaaggccuaccggcaugcgauggaggaacugcccgacaccauugagacccucaugcugcuugcccugaucgcuguccucacaggcgggguuacccuguucuuucugucuggaaagggccucgggaaaacaagcaucggacuucugugugugacggccuccucugcucugcucuggauggccagcguggagccgcacuggauugccgcuuccaucauucuggaauucuuucuuaugguccugcucaucccugagcccgaucgccagagaaccccucaagacaaucagcuggcguaugugguuauuggccugcucuucaugauccuuacaguggccgcuaacgaaauggggcugcuggagaccacaaagaaagaucucggaaucggcuacgucgccgccgagaaccaucagcacgcuaccaugcuggacguggaucuucggcccgccagcgcguggacgcuguacgccgucgcuaccacagugauuaccccuaugaugcgccacacaaucgaaaauaccacggccaacauuucucucacagcuaucgccaaucaagcggccauucugaugggccuggacaagggguggcccaucuccaaaauggauauuggaguuccgcuccuugcucugggcugcuauagccaggugaacccucugacccucacagccgcuguccugaugcuuguggcccauuacgcuaucaucgggcccggacugcaggccaaggcgaccagagaggcccagaagcggaccgcugccggcauuaugaaaaaucccacaguugacgggaucguggcuauugaucucgacccugucguguaugacgccaaguuugaaaaacaacugggacagaucaugcugcucauucuuuguacgucucagauccugcugaugcgcaccacaugggcccucugcgaguccaucacccuggcgacaggcccgcuuaccacgcugugggaaggcagccccgggaaguucuggaacacaaccauugcugugucuauggccaauaucuucagaggaagcuaccucgcuggcgccgggcuggccuuuucccugaugaaaucucucggaggcgggcggcgcggaaccggcgcucagggcgagacacuuggggagaaguggaagagacaacugaaccagcugagcaaauccgaauucaauaccuauaagcggagcggaauuauggagguugauagauccgaagccaaagagggccucaagcgcggggaaacaacgaaacacgcggucucucggggaaccgccaagcugagaugguuuguggagcgcaaccuugugaagccugagggcaaagucaucgaccugggguguggacggggcggcuggagcuacuauugcgcugggcucaagaaaguuacagaagugaagggauacaccaaaggcgggcccggacaugaggaaccuauucccauggccacauacggcuggaaucuggugaagcugcacuccgggaaagaugucuucuuuaugccuccggagaagugugacacccuccuuugcgauaucggagaaucuagccccuccccuacgaucgaggagggcagaacccugcgcgugcugaagaugguugaacccuggcuccggggcaaccaguucuguauuaaaauccugaauccuuauaugcccucuguggucgagacacuugaacagaugcaaagaaagcaugggggaaugcuggugcgcaacccgcucagccggaauuccacccacgagauguacuggguuagcugcggcacagggaacauugugucugcugucaauaugaccuccagaaugcugcugaaccgcuuuacaauggcccaccggaaaccuaccuaugagagagacguggaucucggagcgggcacgcgccauguggccgucgaacccgagguugcuaaccuggacaucauugggcagagaaucgaaaauauuaagaacgagcacaaaagcacauggcauuacgaugaagacaaucccuauaagaccugggccuaccacggaucuuaugaggugaagccuuccggcagcgcuucuuccauggugaacggcgucgugcggcuucugaccaaacccugggauguuaucccuauggugacacagaucgccaugacggacaccacaccguucgggcaacagcgcgucuuuaaggagaaaguggacaccagaacaccccgggcuaagagaggaaccacacagauuauggaaguuaccgccaaauggcucuggggcuuccugagccggaauaagaagccucgcaucuguacgagagaggaauuuacccggaaagugcgcuccaacgcggccauuggggcugucuucguggaugagaaucaguggaacagcgccaaggaagcuguugaggacgagagauuuugggaucuugugcaccgggaacgcgagcugcauaaacaaggaaagugcgccacaugcgucuacaauaugaugggcaaaagagaaaagaagcucggggaguucggcaaagccaagggaucucgggcgaucugguacauguggcugggcgcucgcuuccuggaauuugaggcccucggguucaugaacgaggaccacugguuuagcagagaaaauucccugucuggaguggagggcgaagggcuucauaaacugggauauauucuccgggauaucagcaagauccccggcgggaacauguacgccgacgauaccgcuggcugggacacacgcauuaccgaggaugaccugcagaaugaggccaaaaucacggauauuauggaaccugagcacgcucuucuggccacauccaucuucaagcucaccuaucagacaaaagucgugagaguucagcggcccgcgaagaacggaaccgugauggacgucauuucucgcagagaucaacggggcagcgggcaggugggaacguacggccugaauaccuuuacaaacauggaagugcagcugaucagacagauggaguccgaagggaucuuccucccgucugagcuggagaccccuaaccuugccgaacgcguucuggacuggcucgagaagcauggagcugaacggcugaaaagaauggccauuagcggcgacgauuguguggucaagcccaucgacgaucgcuuugcuacagcccuuaccgcgcugaaugacauggggaaagugcggaaggauauuccucaaugggagcccuccaaaggcuggaacgacuggcagcagguuccuuucugcagccaccacuuucaucagcucaucaugaaggauggaagagaaauugugguccccugucgcaaucaagacgagcuggugggccgggccagagucucucagggggcuggauggucccugcgcgagacagccugccucggcaagagcuaugcucagauguggcaacugauguacuuccaccggagagaucuucgccuggccgcuaacgccaucuguucugcggugccgguugacugggugccuaccucccggacgacauggagcauccaugcccaccaccaguggaugaccaccgaagauaugcucuccgucuggaauagaguguggauugaggaaaaccccuggauggaggacaaaacacauguuucuagcugggaagaggugcccuaucuggggaagcgggaggaccaguggugcggaucccuuaucggccugaccgcuagagccacaugggccacgaauauucaggucgcuaucaaccaagugcgccggcucauugggaaugaaaacuaccuggauuacaugaccagcaugaaaagauuuaagaaugagucugacccugaaggcgcccugugguga

SEQ ID NO: 18509 - RNA, 9879 nt, Artificial Sequence
  derived and/or modified CDS sequence (opt5) from DENV-1__GU131948__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaucuggcucucauggccacguuuaaaaugcggccuauguucgcggucggccugcucuuucgcagacugaccucucgggagauccuucugcucacaauugggcugagccugguggcuuccguggaacuucccaacucucuggaggaacucggagacggccuggccauggggaucaugaugcucaagcugcuuaccgaguuccaaccccaccagcuguggacaacccuccugagccugacguuugucaaaacaacccuuucccuggauuacgccuggaagaccacagcuaugguucucagcaucgugucucuguucccucucugucuguccaccacaagccagaaaacgaccuggcuuccggugcugcugggaucuuuuggcugcaagccccucacaauguuccugauuaccgaaaacaagaucuggggccgcaaauccuggccucuuaaugaggggauuauggccaucggaauugucagcauccugcucucuucccugcucaagaacgacgugccccuggcuggcccucuuaucgccgggggaaugcugauugcguguuauguuaucagcggcuccagcgccgaucugucucucgagaaagcugccgaagugagcugggagcaggaagcugagcauuccggggccucucacaauauucuggucgaagugcaagacgauggaacaaugaagaucaaagacgaggagagagaugacacccuuacgauucugcucaaggccacccugcucgcuguuagcggcguguaccccauguccaucccugcgacacuguuugucugguauuucuggcagaaaaagaagcagcggucuggcgugcuuugggauacccccagcccgccugaagucgagcgcgccgugcuggacgaugggaucuacagaauucugcagcggggacuccugggccgcucccaaguuggggugggagucuuccaggacggcguguuucauacaauguggcacguuaccagaggggcugugcuuauguaucagggaaaacggcuggaacccucuugggccagcgucaagaaagaccucaucuccuacggcggcggguggagauuccagggaagcuggaacacaggcgaggaggugcaagugauugccguugaaccugggaagaaucccaaaaacguccagacgaccccgggaaucuuuaagacaccugagggcgaagugggggcuauugcccuggauuucaagcccggaaccucuggcuccccuaucgugaaucgcgagggcaaaauugucgggcucuacggaaacggcgugguuaccacaagcgggacguaugugucugcgaucgcucaggccaaggccucccaagaaggaccccugcccgagaucgaggacgaagucuuuaaaaagcggaaucuuaccauuauggaucugcacccuggcagcgggaaaacaagacgcuaccugccggcuaucgugcgggaggccauuaagagaaagcuccgcacccugauccuugcgcccacacggguuguggcuuccgaaauggccgaggcccugaaaggcaugccuauuagauaucagaccacggcugucaagucugaacauacaggacgcgagaucguggaccucaugugccacgccaccuucaccaugcggcugcugagccccguuagagugccuaacuacaauaugaucauuauggaugaggcucauuuuacagaccccgccuccaucgcggcccggggcuauauuagcacccgcgucgggaugggagaagcugccgcuaucuucaugacagccaccccuccgggcucuguggaggccuuuccccaguccaacgcugugauucaggaugaagagagagacaucccugaacggagcuggaauucuggguacgauuggaucacggacuuccccggaaaaacagucugguuuguuccuagcauuaaguccggcaacgauaucgcgaauugucuccgcaaaaacgggaagagagugauucaacuuucucggaagaccuucgacacagaguaucagaaaaccaagaacaaugacugggauuacguggucacgaccgacaucagcgagaugggcgccaacuucagagcugaucgcgugauugacccccggagaugccugaaaccgguuauccugaaggauggaccugaacgcgugauucucgccggccccaugcccgucacaguggccuccgcugcccagcggagagggcgcaucggacggaaucagaacaaagagggcgaccaauacguuuauauggggcagccucugaauaacgaugaagaccacgcgcauuggaccgaggcuaagaugcuucuggauaauaucaacacacccgagggaauuaucccugcccucuuugaaccggagagagaaaagucugccgcuauugacggcgaguaccgccugagaggggaagcccggaaaaccuucguggagcugaugcgcagaggcgaucuccccgucuggcuuagcuauaagguggcguccgagggauuucaguacagcgaccggcgcuggugcuucgauggcgaaagaaauaaccagguccuggaggaaaauauggacguggagaucuggacaaaagaaggggagcggaagaaacugagaccucgcuggcucgacgcccggaccuauucugauccccuggcucuuagagaguuuaaggaauucgccgcuggacgccgguccauuagcggcgaccugauccucgagaucgggaaacugccucaacaccugacgcucagagcccagaacgcucuugauaaucugguuaugcugcacaacuccgaacagggaggcaaggccuaccggcaugcgauggaggaacuccccgacacaauugagacccugaugcuucuggcccucaucgcugugcugaccggcggggugacacuguuuuuccucucuggaaagggccuugggaaaaccagcauuggacugcugugugucacagccuccucugcucuccuguggauggccagcguugagccgcacuggaucgccgcuuccauuauccuugaauuuuuccugauggugcuccugaucccugagcccgaucgccagagaacgccucaagacaaucagcuggcguauguggucauuggccuccuuuuuaugauccugaccguggccgcuaacgaaauggggcugcucgagacaaccaagaaagaucugggaauuggcuacguugccgccgagaaccaucagcacgcuacaaugcuugacguggaucugcggcccgccagcgcguggacccucuacgccgucgcuacgaccgugaucacaccuaugaugcgccacaccauugaaaauacaaccgccaacaucucucugacggcuauugccaaucaagcggccauccugaugggccucgacaagggguggcccaucuccaaaauggauauuggagucccgcuucuggcucugggcugcuauagccaggugaacccucucacacugaccgccgcuguucuuaugcugguggcccauuacgcuaucauugggcccggacuccaggccaaggcgacaagagaggcccagaagcggaccgcugccggcaucaugaaaaaucccaccgucgacgggauuguggcuaucgaucuggacccuguuguguaugacgccaaguucgaaaaacaacugggacagaucaugcuccuuauucuguguacaucucagauccugcucaugcgcacgaccugggcccugugcgaguccauuacacuugcgaccggcccgcugacaacccucugggaaggcagccccgggaaguuuuggaacacgacaaucgcugucucuauggccaauauuuucagaggaagcuaccuggcuggcgccgggcuggccuucucccucaugaaaucucuuggaggcgggcggcgcggaaccggcgcucagggcgagacccugggggagaaguggaagagacaacugaaccagcucagcaaauccgaauuuaauacauauaagcggagcggaaucauggagguggauagauccgaagccaaagagggccugaagcgcggggaaaccacaaaacacgcggugucucggggaacggccaagcuuagaugguucguugagcgcaaccuggucaagccugagggcaaagugaucgaccucggguguggacggggcggcuggagcuacuauugcgcugggcugaagaaagugaccgaagucaagggauacacaaaaggcgggcccggacaugaggaaccuauucccauggccaccuacggcuggaaucugguuaagcuccacuccgggaaagauguguuuuucaugccuccggagaagugugacacacuucugugcgauaucggagaaucuagccccaacccuaccauugaggagggcagaacgcugcgcgugcucaagauggucgaacccuggcugcggggcaaucaguuuuguaucaaaauucuuaacccuuauaugcccuccgugguugagacccuggaacagaugcaaagaaagcaugggggaaugcucgugcgcaauccgcugucucggaacagcacacacgagauguacugggucuccugcggcaccgggaauaucgugagcgcuguuaacaugacaucuagaaugcugcucaaccgcuucaccauggcccaccggaaaccuacauaugagagagacguggaucugggagcgggcacccgccaugucgccguggaacccgagguggcuaaucuugacauuaucgggcagagaaucgaaaacauuaagaaugagcacaaauccacguggcauuacgaugaagacaaccccuauaagacaugggccuaccacggaagcuaugaggucaagccuucuggcuccgcuagcucuaugguuaauggcguggugcggcugcucaccaaacccugggaugucaucccuauggugacccagauugccaugacagacacgaccccguuugggcaacagcgcguuuucaaggagaaaguggacacaagaaccccccgggcuaagagaggaacaacccagaucauggaagucacagccaaauggcuguggggcuuucuuucccggaacaagaagccucgcauuuguaccagagaggaauucacgcggaaagugcgcagcaaugcggccaucggggcuguuuuuguggaugagaaccaguggaauuccgccaaggaagcugucgaggacgagagauucugggaucuggugcaccgggaacgcgagcuccauaaacaaggaaagugcgccaccugcguuuacaacaugaugggcaaaagagaaaagaagcugggggaguuuggcaaagccaagggaagccgggcgaucugguacauguggcugggcgcucgcuuccucgaauucgaggcccugggguuuaugaaugaggaccacugguucucuagagaaaacagccuuuccggaguggagggcgaagggcugcauaaacucggauauauucugcgggauaucucuaagauucccggcgggaauauguacgccgacgauacagcuggcugggacacccgcaucacagaggaugaccuucagaacgaggccaaaauuaccgauaucauggaaccugagcacgcucugcucgccacgagcaucuuuaagcugacauaucagaauaaagucgugagaguccagcggcccgcgaagaacggaaccgugauggacguuauuucccgcagagaucaacggggcucugggcaggugggaacauacggccugaacaccuucacgaauauggaaguccagcucaucagacagauggagagcgaagggauuuuucugccguccgagcuugagaccccuaaccuggccgaacgcgugcucgacuggcuggagaagcauggagcugaacggcuuaaaagaauggccaucucuggcgacgauugugugguuaagcccauugacgaucgcuucgcuacagcccugaccgcgcucaaugacauggggaaagugcggaaggauacaccucaaugggagcccagcaaaggcuggaacgacuggcagcaggucccuuuuugcucccaccacuuccaucagcugaucaugaaggauggaagagaaaucgugguucccugucgcaaucaagacgagcuggugggccgggccagagucagccagggggcuggauggucucuccgcgagaccgccugccugggcaaguccuaugcucagauguggcaacuuauguacuuucaccggagagaucugcgccucgccgcuaacgccauuuguagcgcggugccggucgacugggugccuacaucucggaccacgugguccauccaugcccaccaccaguggaugacaaccgaagauaugcugagcguuuggaauagaguguggauugaggaaaaccccuggauggaggacaaaacccaugucuccucuugggaagaggugcccuaucuugggaagcgggaggaccaguggugcggaagccugaucggccucacagcuagagccaccugggccacaaauauucagguugcuaucaaccaagugcgccggcugauugggaaugaaaacuaccuggauuacaugacguccaugaaaagauucaagaaugagagcgacccugaaggcgcccucugguga

SEQ ID NO: 18510 - RNA, 9879 nt, Artificial Sequence
  derived and/or modified CDS sequence (opt5) from DENV-1__GQ868562__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucagcacgaaaaccugaaauacucugugaucgucacggugcauaccggcgaucagcaccaaguugggaaugagacaaccgaacauggaacaaucgcuaccauuacgccccaggccccuaccuccgagauccagcugacagacuauggcgcccucacccuggacuguagcccccggacaggccuugauuucaacgaaauggugcugcucaccaugaaggagaaaucuuggcugguccacaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcauaccgcccugacaggggccacggaaauucagaccagcggaacaaccacaaucuuugcuggccaccuuaaaugcagacugaagauggacaaacucacccugaaggggauguccuacgugauguguacgggcagcuucaaacuggagaaggaagucgccgagacacagcauggaaccgugcuuguucaggugaaguaugagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuacaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaccagguguucgggaccgccuauggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucauacauggaccgaacaauacaaguuucaggcugauagcccuaaacggcucuccgccgcgauuggcaaggccugggaggagggggugugcggcaucagaucugcuacgcgccuggaaaauauuauguggaaacagaucagcaacgagcuuaaucacauccugcucgaaaacgacaugaaguucacagucguggugggagacgccaauggcauucuggcucaggggaaaaagaugauccggccgcaacccauggagcacaaauauuccuggaagucuuggggaaaggccaaaauuaucggcgccgauauucagaacaccaccuuuaucaucgacgggccugauacacccgaauguccugacggacagagagcuuggaauauuugggaggucgaggauuacggcuucggcaucuuuaccacgaacauuuggcugaagcuucgcgacagcuauacacagaugugcgaucaucggcucauguccgcggccaucaaagacagcaaggcuguucacgccgauaugggguacuggauugaaucugagaaaaaugaaaccuggaagcuggccagagcuuccuucaucgaggugaagacauguaccuggcccaaaagccauacacuguggucuaacggagugcucgaauccgagaugaucauuccgaagaucuauggcgggccuauuagccaacacaauuaccgccccggauauuucacccagacggccggcccuuggcaccuggggaaacuugagcuggacuuugaucucugcgaaggaaccacagucgugguugacgagcauugcggcaaccggggccccucucugagaaccacaaccgugacggggaagaucauucacgaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacacaucuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaccagcuguggacaacccuccugagccugacguuuguuaaaacaacccuuucccuggauuacgccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuaucgccgggggaaugcugaucgcguguuaugugauuagcggcuccagcgccgaucugucucucgagaaagcugccgaagucagcugggagcaggaagcugagcauuccggggccucucacaauauccugguggaaguucaagacgauggaacaaugaagauuaaagacgaggagagagaugacacccuuacgauccugcucaaggccacccugcucgcugugagcggcgucuaccccauguccauuccugcgacacuguuugugugguauuucuggcagaaaaagaagcagcggucuggcguccuuugggauacccccagcccgccugaaguggagcgcgccguucuggacgaugggaucuacagaauccugcagcggggacuccugggccgcucccaagugggggucggaguguuccaggacggcguuuuucacacaauguggcaugugaccagaggggcuguccuuauguaucagggaaaacggcuggaacccucuugggccagcgugaagaaagaccucauuuccuacggcggcggguggagauuccagggaagcuggaacacaggcgaggaggugcaaguuaucgccgucgaaccugggaagaaucccaaaaacgugcagacgaccccgggaacauuuaagaccccugagggcgaagugggggcuauugcccuggauuucaagcccggaaccucuggcuccccuaucgucaaucgcgagggcaaaauuguggggcucuauggaaacggcguugugacaacgagcgggaccuacgucucugcgaucgcucaggccaaggccucccaagaaggaccccugcccgagauugaggacgaaguguuuaaaaagcggaaucuuacaaucauggaucugcacccuggcagcgggaaaaccagacgcuaccugccggcuaucguucgggaggccauuaagagaaagcuccgcacacugauccuugcgcccacccggguggucgcuuccgaaauggccgaggcccugaaaggcaugccuauuagauaucagacgacagcugugaagucugaacauaccggacgcgagaucguugaccucaugugccacgccaccuucacaaugcggcugcugagccccgugagagucccuaacuacaauaugauuaucauggaugaggcucauuuuaccgaccccgccuccaucgcggcccggggcuauauuagcacacgcguggggaugggagaagcugccgcuaucuucaugaccgccacgccuccgggcucuguggaggccuuuccccaguccaacgcugucauucaggaugaagagagagacaucccugaacggagcuggaauucuggguacgauuggauuacagacuuccccggaaaaaccguuugguuugugccuagcaucaaguccggcaacgauaucgcgaauugucuccgcaaaaacgggaagagagugauucaacuuucucggaagacauucgacaccgaguaucagaaaacgaagaacaaugacugggauuacgucgugaccacagacaucagcgagaugggcgccaacuucagagcugaucgcguuauugacccccggagaugccugaaaccggugauccugaaggauggaccugaacgcgucauucucgccggccccaugcccgugaccguugccuccgcugcccagcggagagggcgcaucggacggaaucagaacaaagagggcgaccaauauguguacauggggcagccucugaauaacgaugaagaccacgcgcacuggacagaggcuaagaugcuucuggauaauauuaacacccccgagggaaucaucccugcccucuuugaaccggagagagaaaagucugccgcuauugacggcgaguaccgccugagaggggaagcccggaaaacauucgucgagcugaugcgcagaggcgaucuccccguguggcuuagcuauaaggucgcguccgagggauuucaguacagcgaccggcgcuggugcuucgauggcgaaagaaauaaccaggugcuggaggaaaauauggacguugagaucuggaccaaagaaggggagcggaagaaacugagaccucgcuggcucgacgcccggacguauucugauccccuggcucuuagagaguuuaaggaauucgccgcuggacgccgguccgugagcggcgaccugauucucgagaucgggaaacugccucaacaucugacacucagagcccagaacgcucuugauaaucuggugaugcugcacaacuccgaacagggaggcaaggccuaccggcaugcgauggaggaacuccccgacaccauugagacccugaugcuucuggcccucaucgcuguccugacaggcggggccacccuguuuuuccucucuggaaagggccuugggaaaacaagcaucggacugcuguguguuacggcuuccucugcccuccuguggauggccagcguggagccgcacuggauugcugcguccaucauucuugaauuuuuccugauggugcuccugaucccugagcccgaucgccagagaaccccucaagacaaucagcuggccuaugucgugauuggccuccuuuuuaugauccugacaguugcugccaacgaaauggggcugcucgagaccacaaagaaagaucugggaaucggcuacguggccgcugagaaccaccagcaugccaccaugcuugacgucgaucugcggcccgcgagcgccuggacgcucuaugcuguggccaccacagucauuaccccuaugaugcgccacacaaucgaaaauaccacggcuaacauuucucugacagccaucgcgaaucaagccgcuauucugaugggccucgacaagggguggcccaucuccaaaauggauauuggagugccgcuucuggcccugggcugcuacagccagguuaacccucucacccugacagcugccgugcuuaugcuggucgcucauuacgccaucaucgggcccggacuccaggcgaaggccaccagagaggcucagaagcggaccgccgcuggcauuaugaaaaaucccacaguggacgggaucguugccauugaucuggacccuguggucuaugacgccaaguucgaaaaacaacugggacagaucaugcuccuuauucuguguacgucucagauccugcucaugcgcaccacaugggcgcugugcgaguccaucacccuugcuacaggcccgcugaccacgcucugggaaggcagccccgggaaguuuuggaacacaaccauugccgugucuauggcuaauaucuucagaggaagcuaccuggccggcgccgggcuggcuuucucccucaugaaaucucuuggaggcgggcggcgcggaaccggcgcccagggcgagacacugggggagaaguggaagagacaacugaaccagcucagcaaauccgaauuuaauaccuauaagcggagcggaauuauggagguggauagauccgaagcgaaagagggccugaagcgcggggaaacaacgaaacacgccguuucucggggaaccgcuaagcuuagaugguucgucgagcgcaaccuggugaagccugagggcaaagugaucgaccucggguguggacggggcggcuggagcuacuauugcgccgggcugaagaaagucacagaaguuaagggauacaccaaaggcgggcccggacaugaggaaccuauucccauggcuacauauggcuggaaucuggugaagcuccacuccgggaaagauguguuuuucaugccuccggagaagugugacacccuucugugcgauaucggagaaucuagccccaacccuacgaucgaggagggcagaacccugcgcguccucaagaugguggaacccuggcugaaaggcaaucaguuuuguauuaagauccuuaacccuuacaugcccuccguuguggagacacuggaacagaugcaacggaaacacgggggaaugcucgucagaaauccgcugucucgcaacagcacccaugagauguacuggguguccugcggcacagggaauauuguuagcgccgugaacaugaccucucggaugcugcucaacagauucacaauggcgcaccgcaagccuaccuaugagcgggacgucgaucugggagccggcacgagacauguggcuguggaacccgaggucgccaaucuugacaucauugggcagcgcaucgaaaacauuaaaaaugagcacaaguccacauggcacuacgaugaagacaaccccuauaagaccugggcuuaccauggaagcuaugagguuaaaccuucuggcuccgccagcucuauggugaauggcguggucagacugcucaccaagcccugggaugugaucccuaugguuacacagaucgcuaugacggacaccacaccguuugggcaacagcggguguucaaagagaaggucgacacccgcacacccagagccaaacggggaaccacacagauuauggaagugaccgcgaaguggcuguggggcuuucuuuccagaaacaagaaaccucggaucuguacgcgcgaggaauucaccagaaagguucggagcaaugccgcuauuggggccguguuugucgaugagaaccaguggaauuccgcuaaagaagccguggaggacgagcgcuucugggaucugguucacagagaacgggagcuccauaagcaaggaaaaugcgccacaugcguguacaacaugaugggcaagcgcgaaaagaaacugggggaguuuggcaaggcgaaaggaagcagagcuaucugguauauguggcugggcgcccgguuccucgaauucgaggcccugggguuuaugaaugaggaccacugguucucucgcgaaaacagccuuuccggagucgagggcgaagggcugcauaagcucggauacauucugagagauaucucuaaaauccccggcgggaauauguacgcugacgauaccgccggcugggacacacggauuaccgaggaugaccuucagaacgaggcuaagaucacggauauuauggaaccugagcacgcccugcucgcgacaagcaucuuuaaacugaccuaucagaauaaggugguccgcgugcagagacccgccaagaacggaacaguuauggacgugauuucccggcgcgaucaaagaggcucugggcaggucggaaccuacggccugaacacguucaccaauauggaagugcagcucauccggcagauggagagcgaagggaucuuucugccguccgagcuugagacaccuaaccuggcugaaagagugcucgacuggcuggagaaacacggagccgaacgccuuaagcggauggcuauuucuggcgacgauuguguugugaaacccaucgacgauagauucgccaccgcgcugacagcccucaaugacauggggaagguccgcaaagauauuccucaaugggagcccagcaagggcuggaacgacuggcagcaggugccuuuuugcucccaucacuuccaucagcugaucaugaaggauggacgggaaauuguugugcccuguagaaaucaagacgagcuggucggccgcgcucgggugagccagggggccggauggucucucagagagaccgcuugccugggcaaauccuaugcccagauguggcaacuuauguacuuucaccgccgggaucugagacucgcugccaacgcgaucuguagcgccgucccgguggacuggguuccuacaucucgcaccacgugguccauccacgcucaucaccaguggaugacaaccgaagauaugcugagcguguggaaucgggucuggauugaggaaaaccccuggauggaggacaagacccauguguccucuugggaagagguucccuaucuugggaaaagagaggaccaguggugcggaagccugaucggccucacagcccgggccaccugggcuacaaauauucagguggccaucaaccaagucagacgccugauugggaaugaaaacuaccuggauuauaugacguccaugaagcgguucaaaaaugagagcgacccugaaggcgcgcucugguga

SEQ ID NO: 18511 - RNA, 9879 nt, Artificial Sequence
  derived and/or modified CDS sequence (opt5) from DENV-1__GQ868563__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacgcuaccuuuaucaucgacgggccugauacccccgaauguccugacggacagagagcguggaauauuugggaggucgaggauuauggcuucggcaucuuuacaaccaacauuuggcugaagcuucgcgacagcuacacgcagaugugcgaucaccggcucauguccgccgcuaucaaagacagcaaggccguucaugccgauaugggguauuggauugaaucugagaaaaaugaaacauggaagcuggcuagagccuccuucaucgaggugaagaccuguacauggcccaaaagccacacccuguggucuaacggagugcucgaauccgagaugaucauuccgaagaucuacggcgggccuauuagccaacauaauuaucgccccggauacuucacacagaccgcgggcccuuggcaccuggggaaacuugagcuggacuuugaucucugcgaaggaacgaccgucgugguugacgagcacugcggcaaccggggccccucucugagaacaaccacagugaccgggaagaucauucaugaaugguguugccggagcuguacgcugccuccccuucgcuucagaggagaggauggcugcugguacgggauggagauccggccggucaaagaaaaggaggaaaaucucgugagauccaugguuagcgcuggaucuggcgagguggacuccuuuagccuggggauccugugugucuccauuaugaucgaagaggugaugcgcucucgguggagcagaaagaugcucaugacaggaacccuggccguuuuccuucugcucauuaugggccagcugacauggaacgaccugacccgccuuugcaucauggugggcgccaaugcuuccgauagaauggggaugggaaccacauaucuggcccucauggcgacguuuaaaaugcggccuauguucgcugucggccugcucuuucgcagacugaccucucgggaggugcuucugcucacaauugggcugagccugguggccuccgucgaacuucccaacucucuggaggaacucggagacggccuggccauggggaucaugaugcucaagcugcuuaccgaguuccaaccccaccagcuguggacaacccuccugagccugacguuuguuaaaacaacccuuucccuggauuacgcuuggaagaccacagccauggugcucagcauugugucucuguucccucucugucuguccaccacaagccagaaaacgaccuggcuuccgguccugcugggaucuuuuggcugcaagccccucacaauguuccugaucaccgaaaacaagaucuggggccgcaaauccuggccucuuaaugaggggauuauggcuaucggaauugugagcauccugcucucuucccugcucaagaacgacguuccccuggccggcccucuuauugcggggggaaugcugaucgccuguuaugugaucagcggcuccagcgcugaucugucucucgagaaagccgcugaagucagcugggagcaggaagccgagcauuccggggccucucacaauauucugguggaaguucaagacgauggaacaaugaagaucaaagacgaggagagagaugacacccuuacgauucugcucaaggcuacccugcucgcggugagcggcgucuaccccauguccaucccugccacacuguuugugugguauuucuggcagaaaaagaagcagcggucuggcguccuuugggauacccccagcccgccugaaguggagcgcgcuguucuggacgaugggauuuacagaauccugcagcggggacuccugggccgcucccaagugggggucggaguguuccaggacggcguuuuucauacaauguggcacgugaccagaggggccguccuuauguaucagggaaaacggcuggaacccucuugggccagcgugaagaaagaccucaucuccuacggcggcggguggagauuccagggacuguggaacacaggcgaggaggugcaaguuauugcugucgaaccugggaagaaucccaaaaacgugcagacgaccccgggaacauuuaagaccccugagggcgaagugggggccaucgcgcucgauuucaagcccggaaccagcggcucuccuauugucaaucgcgagggcaaaaucguggggcuguacggaaacggcguugugacaacguccgggaccuaugucagcgcuauugcccaggccaaggcuucucaagaaggaccccuucccgagaucgaggacgaaguguuuaaaaagcggaaucugacaauuauggaucugcacccuggcuccgggaaaaccagacgcuaccucccggccaucguucgggaggcgaucaagagaaagcugcgcacacuuauucuggcucccacccggguggucgccagcgaaauggccgaggcucucaaaggcaugccuaucagauaucagacgacagccgugaaguccgaacauaccggacgcgagauuguugaccugaugugccacgcuaccuucacaaugcggcugcucucucccgugagagucccuaacuacaauaugaucauuauggaugaggcccauuuuaccgaccccgcgagcaucgccgcucggggcuauaucuccacacgcguggggaugggagaagccgcugccauuuucaugaccgccacgccuccgggcagcguggaggcuuuuccccagucuaacgcggucauccaggaugaagagagagacauuccugaacgguccuggaauagcggguacgauuggaucacagacuuccccggaaaaaccguuugguuugugccuucuauuaagagcggcaacgauaucgccaauugucuucgcaaaaacgggaagagagugauccaacugucccggaagacauucgacaccgaguaucagaaaacgaagaacaaugacugggauuacgucgugaccacagacauuucugagaugggcgcuaacuucagagccgaucgcguuaucgacccccggagaugccugaaaccggugauucucaaggauggaccugaacgcgucauccuggccggccccaugcccgugaccguugcuagcgccgcgcagcggagagggcgcauuggacggaaucagaacaaagagggcgaccaauacguguauauggggcagccucuuaauaacgaugaagaccacgcucauuggacagaggccaagaugcugcucgauaauaucaacacccccgagggaauuaucccugcccuguuugaaccggagagagaaaaguccgcugccaucgacggcgaguaccgccugagaggggaagcgcggaaaacauucgucgagcucaugcgcagaggcgaucuucccguguggcugucuuauaaggucgccagcgagggauuucaguacuccgaccggcgcuggugcuucgauggcgaaagaaauaaccaggugcuggaggaaaauauggacguugagauuuggaccaaagaaggggagcggaagaaacucagaccucgcuggcuggacgcucggacguauagcgauccccuugcccugagagaguuuaaggaauucgcugccggacgccggucuguguccggcgaccucauccuggagauugggaaacugccucaacaccucacacuuagagcucagaacgcccuggauaaucuggugaugcuccacaacagcgaacagggaggcaaggcguaccggcaugccauggaggaacugcccgacaccaucgagacccuuaugcugcucgcucugauugccguccugacaggcgggguuacccucuuuuuccuuuccggaaagggccuggggaaaacaucuaucggacugcucugugugacggcuagcuccgcccugcuuuggauggccucuguggagccgcacuggaucgcugcgagcauuauccuggaauuuuuccucaugguccugcugauuccugagcccgaucgccagagaaccccucaagacaaucagcucgccuaugugguuaucggccuucuguuuaugauucugacaguggcugccaacgaaauggggcuccuggagaccacaaagaaagaucuuggaaucggcuacgccgcugccgagaaccaucagcacgcgaccaugcuggacgucgaucuccggcccgccuccgcuuggacgcuguacgccguggcuaccacagucaucaccccuaugaugcgccacacaauugaaaauaccacggccaacaucagccugacagcgauugccaaucaagcugccauccucaugggccuugacaagggguggcccauuucuaaaauggauaucggagugccgcugcuggcucucggcugcuauucccagguuaacccucugacccuuacagccgcugugcugaugcucgucgcccauuacgcgauuaucgggcccggacugcaggccaaggcuaccagagaggcccagaagcggaccgcugccggcaucaugaaaaaucccacaguggacgggauuguugccaucgaucuggacccuguggucuaugacgcgaaguucgaaaaacaacucggacagauuaugcuucugauccuguguacgagccagauucuccugaugcgcaccacaugggcucuuugcgagucuaucacccuggccacaggcccgcucaccacgcugugggaaggcucccccgggaaguuuuggaacacaaccaucgcugugagcauggccaauauuuucagaggaucuuaccuggccggcgcugggcucgccuucagccuuaugaaaucccugggaggcgggcggcgcggaaccggcgcgcagggcgagacacugggggagaaguggaagagacaacucaaccagcugucuaaaagcgaauuuaauaccuauaagcgguccggaaucauggagguggauagaagcgaagccaaagagggccuuaagcgcggggaaacaacgaaacacgcuguuucccggggaaccgccaagcugagaugguucgucgagcgcaaccucgugaagccugagggcaaagugauugaccugggguguggacggggcggcuggucuuacuauugcgcugggcugaagaaagucacagaaguuaagggauacaccaaaggcgggcccggacaugaggaaccuauccccauggccacauacggcuggaaucucgugaagcuucacagcgggaaagauguguuuuucaugccuccggagaagugugacacccugcugugcgauauuggagaauccucucccaacccuacgaucgaggagggcagaacccuccgcguccugaagaugguggaacccuggcuucggggcaaucaguuuuguaucaaaauucugaacccuuauaugcccagcguuguggagacacucgaacagaugcaaagaaagcaugggggaaugcugguccgcaauccgcugucccggaacucuacccacgagauguacugggugagcugcggcacagggaauaucguuuccgcggugaacaugaccagcagaaugcuccugaaccgcuucacaauggcccaccggaaaccuaccuaugagagagacgucgaucuuggagcuggcacgcgccauguggccguggaacccgagguccccaaucuggacauuaucgggcagagaauugaaaacaucaagaaugagcacaaaucuacauggcauuacgaugaagacaacccuuauaagaccugggcuuaccacggauccuaugagguuaagcccagcggcucugccuccagcauggugaauggcgugguccggcuccugaccaaaccuugggaugugauuccgaugguuacacagaucgcuaugacggacaccacacccuuugggcaacagcgcguguucaaggagaaagucgacaccagaacaccucgggccaagagaggaaccacacagaucauggaagugaccgcgaaauggcuuuggggcuuucugucucggaacaagaagccccgcauuuguacgagagaggaauucacccggaaaguucgcuccaaugccgcuaucggggccguguuugucgaugagaaccaguggaauagcgcuaaggaagccguggaggacgagagauucugggaucucguucaccgggaacgcgagcugcauaaacaaggaaagugcgccacaugcguguacaacaugaugggcaaaagagaaaagaagcugggggaguuuggcaaagcgaagggaucccgggcuauuugguacauguggcucggcgcccgcuuccuggaauucgaggcccuuggguuuaugaaugaggaccacugguucagcagagaaaacucucugagcggagucgagggcgaagggcuccauaaacugggauauauccuucgggauauuuccaagaucccuggcgggaauauguacgcugacgauaccgccggcugggacacacgcaucaccgaggaugaccugcagaacgaggcuaaaauuacggauaucauggaacccgagcacgcccuccuggcgacaucuauuuuuaagcugaccuaucagaauaaaguggucagagugcagcggccggccaagaacggaacaguuauggacgugaucagccgcagagaucaacggggcuccgggcaggucggaaccuacggccucaacacguucaccaauauggaagugcagcugauuagacagauggagucugaagggaucuuucuuccuagcgagcuggagacacccaaccucgcugaacgcgugcuggacuggcuugagaagcauggagccgaacggcugaaaagaauggcuaucuccggcgacgauuguguugugaagccuauugacgaucgcuucgccaccgcgcucacagcccugaaugacauggggaaaguccggaaggauaucccccaaugggagccuucuaaaggcuggaacgacuggcagcaggugcccuuuugcagccaccacuuccaucagcugauuaugaaggauggaagagaaaucguugugccgugucgcaaucaagacgagcucgucggccgggcuagagugucccagggggccggauggagccugcgcgagaccgcuugccuuggcaagucuuaugcccagauguggcaacugauguacuuucaccggagagaucuccgccuggcugccaacgcgauuuguuccgccgucccuguggaauggguucccacaagccggaccacguggucuauccaugcucaccaccaguggaugacaaccgaggacaugcuuuccguguggaauagagucuggaucgaagagaaccccuggauggaagauaaaacccaugugagcuccugggaggagguuccuuaucuggggaagcgggaagaccaguggugcggaucucucauuggccugacagccagagccaccugggcuacaaauauccagguggccauuaaccaaguccgccggcugaucgggaaugagaacuaccucgacuacaugacgagcaugaaaagauucaagaaugaauccgauccggagggcgcgcugugguga

SEQ ID NO: 18512 - RNA, 9879 nt, Artificial Sequence
  derived and/or modified CDS sequence (opt5) from DENV-1__GQ868564__SS-prME
agcgugacaaugcugcuuaugcugcuucccacagcccuggcuuuccaccugacgacccggggcggggaaccucauaugaucgucuccaagcaggaacggggaaaagcccugcuuuuuaagacaucugcgggcguuaacaugugcacccugauugcuauggaccucggggaacugugugaagauacaaugaccuacaaaugcccccgcaucacagaggccgaacccgacgauguggacuguuggugcaaugccaccgauacgugggugaccuauggaacauguagccaaaccggcgagcaccggcgggacaagcgcuccgucgcucuggccccucauguggggcucggacuggagacaagaaccgaaacguggaugucuagcgagggcgcuuggaaacagauucagcggguugaaacaugggcccuucgccaccccggcuucaccgugaucgcgcuguuucucgcccaugcuauugggacauccaucacccagaagggaaucauuuucauccugcuuaugcuggucaccccuucuauggccaugagaugcgugggcauugggaaccgggauuuuguugagggacucagcggcgcuacauggguggacgucgugcuggagcacggguccugugugacgaccauggccaagaauaaacccacacuggauaucgaacuccugaagaccgaggucacaaacccugcgguucuucgcaaacugugcauugaagccaagaucagcaauaccacgacagacucuagauguccgacccaaggagaggcuacccucguggaagaacaggaugccaacuucgugugccggcgcacauuugucgacagaggcuggggcaauggguguggacuguucggcaaagggucccuucugaccugcgcuaaguuuaagugcgugacaaaacucgagggaaagauuguucaguacgaaaaccugaaauauagcgugaucgucacggugcacaccggcgaucagcaucaaguugggaaugagacaaccgaacacggaacaaucgccaccauuacgccccaggccccuaccucugagauccagcugacagacuacggcgcucucacccuggacuguagcccccggacaggccuugauuucaacgaaauggugcugcucaccaugaaggagaaaagcuggcugguccauaagcagugguuucuugaccugccucuccccuggacgucuggggcguccacaagccaagagaccuggaaucgccaggaucugcuggugacauucaaaaccgcccacgcuaagaagcaggaagucgugguucucggaucccaagagggcgccaugcacaccgcccugacaggggcuacggaaauucagaccucuggaacaaccacaaucuuugccggccaucuuaaaugcagacugaagauggacaaacucacccugaaggggaugagcuaugugauguguacgggcuccuucaaacuggagaaggaagucgcggagacacagcacggaaccgugcuuguucaggugaaguacgagggcaccgaugcuccgugcaaaauuccuuucagcacacaagacgaaaagggggucacccagaacggacggcucaucacagccaaucccaucgugacggauaaagagaagccugugaacauugaaaccgagccgcccuuuggcgagucuuauaucguugucggggccggagaaaaagcucugaagcuguccugguucaagaaaggcagcucuauugggaagauguuugaggccacagcuagaggcgcccgccggauggcgauccucggagacaccgccugggauuucggcagcauugggggaguguuuacauccgugggcaaacugguccaucagguguucgggaccgcuuacggaguucucuuuucuggcgugagcuggacgaugaagaucgggaucggcauucugcucaccuggcugggacucaauuccagaagcacaucucuuuccaugaccuguaucgccgucggcauggugacacucuaccuggggguuauggugcaggcugacagcggaugcgucauuaacuggaaaggccgcgaacugaagugugggucuggaaucuucgugaccaacgagguucacacauggaccgaacaauauaaguuucaggccgauuccccuaaacggcucagcgcggccauuggcaaggcuugggaggagggggugugcggcaucagauccgccacgcgccuggaaaauauuauguggaaacagaucucuaacgagcuuaaucauauccugcucgaaaacgacaugaaguucacagucguggugggagacgcuaauggcauucuggcccaggggaaaaagaugauccggccgcaacccauggagcacaaauacagcuggaaguccuggggaaaggccaaaauuaucggcgcugauauucagaacaccaccuuuaucaucgacgggccugauacacccgaauguccugacggacagagagcguggaauauuugggaggucgaggauuauggcuucggcaucuuuaccacgaacauuuggcugaaacuucgcgacucuuacacacagaugugcgaucaccggcucaugagcgccgcuaucaaagacuccaaggccguucaugccgauaugggguauuggauugaaagcgagaaaaaugaaaccuggaagcuggcuagagccucuuucaucgaggugaagacauguaccuggcccaaaucccacacacuguggagcaacggagugcucgaaucugagaugaucauuccgaagaucuacggcgggccuauuucccaacauaauuaucgccccggauacuucacccagacggcgggcccuuggcaccuggggaaacuugagcuggacuuugaucucugcgaaggaaccacagucgugguugacgagcacugcggcaaccggggccccagccugagaaccacaaccgugacggggaagaucauucaugaaugguguugccggucuuguacacugccuccccuucgcuucagaggagaggauggcugcugguacgggauggagauccggccggucaaagaaagagaggaaaaucucgugcgcagcaugguuuccgcuggaagcggcgagguggacucuuuuucccuggggauccugugugucagcauuaugaucgaagaggugaugcgguccagauggucucgcaagaugcucaugaccggaacacuggccguuuuccuucugcucauuaugggccagcugaccuggaacgaccugaccagacuuugcaucauggugggcgccaaugcuagcgaucggauggggaugggaacaacguaucuggcccucauggcgaccuuuaagaugcgcccuauguucgcugucggccugcucuuuagacggcugacaucccgcgaggugcuucugcucaccauugggcugucucugguggccagcgucgaacuucccaacucccuggaggaacucggagacggccuggccauggggaucaugaugcucaaacugcuuacagaguuccaaccccaccagcuguggaccacgcuccugucucugacauuuguuaagaccacccuuagccuggauuacgcuuggaaaacaaccgccauggugcucuccauugugagccuguucccucucugucugucuacaacgucccagaagaccacauggcuuccgguccugcugggauccuuuggcugcaaaccccucaccauguuccugaucacagaaaacaagaucuggggcagaaagucuuggccucuuaaugaggggauuauggcuaucggaauuguguccauccugcucagcucucugcucaaaaacgacguuccccuggccggcccucuuauugccgggggaaugcugaucgccuguuaugugaucuccggcagcuccgcugaucugagccucgagaaggccgcugaagucucuugggagcaugaagccgagcacagcggggccucccauaauauucugguggaaguucaggacgauggaaccaugaaaaucaaggacgaggagcgggaugacacgcuuaccauucugcucaaagcugcgcugcucgccgugucuggcgucuaccccaugagcaucccugcuacacuguuugugugguauuucuggcaaaagaaaaagcagcgcuccggcguccuuugggauacccccucuccgccugaaguggagagagccguucuggacgaugggauuuaccggauccugcagcgcggacuccugggcagaagccaggugggggucggaguguuccaagacggcguuuuucacacaauguggcacgugaccagaggggcgguccuuauguaucagggaaagcggcuggaacccuccugggcuucugugaaaaaggaccucaucagcuacggcggcggguggcgcuuccagggauccuggaacacaggcgaggaggugcagguuauugccgucgaaccugggaaaaaucccaagaacgugcaaacgaccccgggaacauuuaaaaccccugagggcgaagugggggcgaucgcucuggauuucaagcccggaaccagcggcucuccuauugucaaucgggagggcaagaucguggggcucuacggaaacggcguugugacaacguccgggaccuaugucagcgccauugcccaggcuaaagccucucaggaaggaccccugcccgagaucgaggacgaaguguuuaagaaaagaaaucuuacaauuauggaucugcauccuggcuccgggaagacccgccgguaccugccggcgaucguuagagaggcuaucaaacgcaagcuccggacacugauucuugcccccaccagaguggucgccagcgaaauggcugaggcccugaagggcaugccuauccgcuaucaaacgacagcugugaaauccgaacacaccggacgggagauuguugaccucaugugccaugccaccuucacaaugagacugcugucucccgugcgggucccuaacuacaauaugaucauuauggaugaggcgcacuuuaccgaccccgccagcaucgcugcccgcggcuauaucuccacaagaguggggaugggagaagcugccgccauuuucaugaccgcuacgccuccgggcagcguggaggcguuuccccagucuaacgccgucauccaggaugaagaacgggacauuccugaacgcuccuggaauagcggguacgauuggaucacagacuuccccggaaagaccguuugguuugugccuucuauuaaaagcggcaacgauaucgcuaauugucucagaaagaacgggaaacgggugauccagcuuuccagaaagacauucgacaccgaguaucaaaagacgaaaaacaaugacugggauuacgucgugaccacagacauuucugagaugggcgccaacuuccgcgccgaucggguuaucgaccccagacgcugccugaagccggugauucugaaagauggaccugaacgggucauccucgcuggccccaugcccgugaccguugccagcgcggcucagagacgcgggcggauuggaagaaaucagaacaaggagggcgaccaguacguguauauggggcaaccucugaauaacgaugaagaccaugcccacuggacagaggccaaaaugcuucuggauaauaucaacacccccgagggaauuaucccugcucucuuugaaccggagcgcgaaaaguccgccgcgaucgacggcgaguacagacugagaggggaagcccgcaagacauucgucgagcugaugagacggggcgaucuccccguguggcuuucuuauaaagucgcuagcgagggauuucaguacuccgaccgcagauggugcuucgauggcgaacggaauaaccaggugcuggaggaaaauauggacguugagauuuggaccaaggaaggggagcgcaagaagcugcgcccucgguggcucgacgccagaacguauagcgauccccuggcucuuagagaguuuaaagaguucgccgcuggacggagaucuguguccggcgaccugauccucgagauugggaagcugccucagcaccugacacuccgggcccaaaacgcgcuugauaaucuggugaugcugcauaacagcgaacagggaggcaaagccuaccgccacgcuauggaggaacuccccgacaccaucgagacccugaugcuucuggcccucauugcuguccugacaggcgggguuacccuguuuuuccucuccggaaagggccuugggaagacaucuaucggacugcugugugugacggccagcuccgcccuccuguggauggcuucuguggagccgcauuggaucgcggccagcauuauccuugaauuuuuccugaugguccuccugauuccugagcccgauagacagcggaccccucaggacaaucaacuggcuuaugugguuaucggccuccuuuuuaugauucugacaguggccgccaacgaaauggggcugcucgagaccaccaaaaaggaucugggaaucggccacgucgcugccgagaaccaccagcaugcgaccaugcuugacguggaucugcgccccgccuccgcuuggacgcucuacgccgucgcuaccacagugaucaccccuaugaugagacacacaauugaaaauaccacggccaacaucagccugacagcgauugccaaucaggcugccauccugaugggccucgacaaaggguggcccauuucuaagauggauaucggaguuccgcuucuggcucugggcugcuacucccaagugaacccucucacccugacagccgcuguccuuaugcugguggcccauuaugcgauuaucgggcccggacuccaggccaaagcuacccgggaggcccagaagcgcaccgcugccggcaucaugaagaaucccacaguugacgggauuguggccaucgaucuggacccugucguguacgacgcgaaauucgaaaagcagcugggacaaauuaugcuccuuauccuguguacgagccagauucugcucaugagaaccacaugggcucugugcgagucuaucacccuugccacaggcccgcugaccacgcucugggaaggcucccccgggaaauuuuggaacacaaccaucgcugugagcauggccaauauuuuccggggaucuuaucuggccggcgcugggcuggccuucagccucaugaagucccuuggaggcgggcgcagaggaaccggcgcgcagggcgagacacugggggagaaauggaagcggcagcugaaccaacucucuaagagcgaauuuaauaccuacaaaagauccggaaucauggagguugaucgcagcgaagccaaggagggccugaaaagaggggaaacaacgaagcacgcugucuccagaggaaccgccaaacuucgcugguucguggagcggaaccuggugaagccugagggcaaggucauugaccucggguguggaagaggcggcuggucuuauuacugcgcugggcugaaaaagguuacagaagugaaaggauauaccaagggcgggcccggacaugaggaaccuauccccauggccacauacggcuggaaucuggugaaacuccacagcgggaaggaugucuuuuucaugccuccggagaaaugugacacccuucugugcgauauuggagaauccucucccaacccuacgaucgaggagggccgcacccugcgggugcucaagaugguugaacccuggcugagaggcaaucaguuuuguaucaagauucuuaacccuuacaugcccagcguggucgagacacuggaacagaugcagcgcaaacacgggggaaugcucgugcggaauccgcuguccagaaacucuacccaugagauguauuggguuagcugcggcacagggaauaucguguccgcggucaacaugaccagccgcaugcugcucaaccgguucacaauggcccacagaaagccuaccuacgagcgcgacguggaucugggagcuggcacgagacauguggccgucgaacccgagguugcuaaucuugacauuaucgggcaacggauugaaaacaucaaaaaugagcacaagucuacauggcacuaugaugaagacaaccccuacaaaaccugggccuaucauggauccuacgaggugaagccuagcggcucugcuuccagcauggugaauggcgucgugcgccugcucaccaagcccugggauguuauuccuauggugacacagaucgccaugacggacaccacaccguuugggcagcaaagagucuucaaagagaagguggacacccggacacccagagcgaaacggggaaccacacagaucauggaaguuaccgccaaguggcuguggggcuuucuuucucgcaacaaaaagccuagaauuuguacgcgggaggaguucacccgcaaggugagauccaaugcugccaucggggcugucuuuguggaugagaaccaguggaauagcgccaaagaagccguugaggacgagcgguucugggaucuggugcaccgcgaaagagagcuccauaagcagggaaaaugcgcgacaugcgucuauaacaugaugggcaagcgggagaaaaagcugggggaguuuggcaaggcuaaaggaucccgcgccauuugguacauguggcugggcgccagauuccucgaguucgaggcucugggguuuaugaaugaggaccacugguucagccgggaaaacucucuuagcggaguggagggcgaagggcugcauaagcucggauacauccugcgcgauauuuccaaaauccccggcgggaauauguaugccgacgauaccgcuggcugggacacaagaaucaccgaggaugaccuucaaaacgaggccaagauuacggauaucauggaaccugagcacgcgcugcucgccacaucuauuuuuaaacugaccuaccagaauaaggucgugcggguucagcgccccgcuaaaaacggaacagugauggacgucaucagcagacgggaucagagaggcuccgggcaagugggaaccuauggccugaacacguucaccaauauggaagugcagcucauucgccagauggagucugaagggaucuuucugccgagcgagcuugagacaccuaaccuggccgaacggguucucgacuggcuggagaagcacggagcugaaagacuuaagcgcauggccaucuccggcgacgauuguguggucaaacccauugacgaucgguucgcgaccgcccugacagcucucaaugacauggggaaggugagaaaagauaucccucagugggagcccucuaagggcuggaacgacuggcaacagguuccuuuuugcagccaucacuuccaucagcugauuaugaaagauggacgcgaaaucgugguccccugucggaaucaggacgagcuggugggcagagcccgcgucucccaaggggcuggauggagccuccgggagaccgccugccugggcaagucuuacgcucagauguggcagcuuauguauuuucacagacgcgaucugcggcucgccgcgaacgccauuuguuccgcugugccgguugaaugggugccuacaagcagaaccacguggucuauccacgcccaucaccaauggaugacaaccgaggacaugcuguccgucuggaaucggguguggaucgaagagaaccccuggauggaagauaagacccauguuagcuccugggaggaggugcccuaccuugggaaaagagaagaccaguggugcggaucucugauuggccucacagcccgcgcuaccugggccacaaauauccaggucgcgauuaaccaggugcggagacugaucgggaaugagaacuaucuggacuacaugacgagcaugaagcgcuucaaaaaugaauccgauccugagggcgcucucugguga

SEQ ID NO: 18513 - RNA, 9879 nt, Artificial Sequence
  derived and/or modified CDS sequence (opt5) from DENV-1__GQ868565__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacgcuaccuuuaucaucgacgggccugauacccccgaauguccugacggacagagagcguggaauauuugggaggucgaggauuauggcuucggcaucuuuacaaccaacauuuggcugaagcuucgcgacagcuacacgcagaugugcgaucaccggcucauguccgccgcuaucaaagacagcaaggccguucaugccgauaugggguauuggauugaaucugagaaaaaugaaacauggaagcuggcuagagccuccuucaucgaggugaagaccuguacauggcccaaaagccacacccuguggucuaacggagugcucgaauccgagaugaucauuccgaagaucuacggcgggccuauuagccaacauaauuaucgccccggauacuucacacagaccgcgggcccuuggcaccuggggaaacuugagcuggacuuugaucucugcgaaggaacgaccgucgugguugacgagcacugcggcaaccggggccccucucugagaacaaccacagugaccgggaagaucauucaugaaugguguugccggagcuguacgcugccuccccuucgcuucagaggagaggauggcugcugguacgggauggagauccggccggucaaagaaaaggaggaaaaucucgugagauccaugguuagcgcuggaucuggcgagguggacuccuuuagccuggggauccugugugucuccauuaugaucgaagaggugaugcgcucucgguggagcagaaagaugcucaugacaggaacccuggccguuuuccuucugcucauuaugggccagcugacauggaacgaccugacccgccuuugcaucauggugggcgccaaugcuuccgauagaauggggaugggaaccacauaucuggcccucauggcgacguuuaaaaugcggccuauguucgcugucggccugcucuuucgcagacugaccucucgggaggugcuucugcucacaauugggcugagccugguggccuccgucgaacuucccaacucucuggaggaacucggagacggccuggccauggggaucaugaugcucaagcugcuuaccgaguuccaaccccaccagcuguggacaacccuccugagccugacguuuguuaaaacaacccuuucccuggauuacgcuuggaagaccacagccauggugcucagcauugugucucuguucccucucugucuguccaccacaagccagaaaacgaccuggcuuccgguccugcugggaucuuuuggcugcaagccccucacaauguuccugaucaccgaaaacaagaucuggggccgcaaauccuggccucuuaaugaggggauuauggcuaucggaauugugagcauccugcucucuucccugcucaagaacgacguuccccuggccggcccucuuauugcggggggaaugcugaucgccuguuaugugaucagcggcuccagcgcugaucugucucucgagaaagccgcugaagucagcugggagcaggaagccgagcauuccggggccucucacaauauucugguggaaguucaagacgauggaacaaugaagaucaaagacgaggagagagaugacacccuuacgauucugcucaaggcuacccugcucgcggugagcggcgucuaccccauguccaucccugccacacuguuugugugguauuucuggcagaaaaagaagcagcggucuggcguccuuugggauacccccagcccgccugaaguggagcgcgcuguucuggacgaugggauuuacagaauccugcagcggggacuccugggccgcucccaagugggggucggaguguuccaggacggcguuuuucauacaauguggcacgugaccagaggggccguccuuauguaucagggaaaacggcuggaacccucuugggccagcgugaagaaagaccucaucuccuacggcggcggguggagauuccagggacuguggaacacaggcgaggaggugcaaguuauugcugucgaaccugggaagaaucccaaaaacgugcagacgaccccgggaacauuuaagaccccugagggcgaagugggggccaucgcgcucgauuucaagcccggaaccagcggcucuccuauugucaaucgcgagggcaaaaucguggggcuguacggaaacggcguugugacaacguccgggaccuaugucagcgcuauugcccaggccaaggcuucucaagaaggaccccuucccgagaucgaggacgaaguguuuaaaaagcggaaucugacaauuauggaucugcacccuggcuccgggaaaaccagacgcuaccucccggccaucguucgggaggcgaucaagagaaagcugcgcacacuuauucuggcucccacccggguggucgccagcgaaauggccgaggcucucaaaggcaugccuaucagauaucagacgacagccgugaaguccgaacauaccggacgcgagauuguugaccugaugugccacgcuaccuucacaaugcggcugcucucucccgugagagucccuaacuacaauaugaucauuauggaugaggcccauuuuaccgaccccgcgagcaucgccgcucggggcuauaucuccacacgcguggggaugggagaagccgcugccauuuucaugaccgccacgccuccgggcagcguggaggcuuuuccccagucuaacgcggucauccaggaugaagagagagacauuccugaacgguccuggaauagcggguacgauuggaucacagacuuccccggaaaaaccguuugguuugugccuucuauuaagagcggcaacgauaucgccaauugucuucgcaaaaacgggaagagagugauccaacugucccggaagacauucgacaccgaguaucagaaaacgaagaacaaugacugggauuacgucgugaccacagacauuucugagaugggcgcuaacuucagagccgaucgcguuaucgacccccggagaugccugaaaccggugauucucaaggauggaccugaacgcgucauccuggccggccccaugcccgugaccguugcuagcgccgcgcagcggagagggcgcauuggacggaaucagaacaaagagggcgaccaauacguguauauggggcagccucuuaauaacgaugaagaccacgcucauuggacagaggccaagaugcugcucgauaauaucaacacccccgagggaauuaucccugcccuguuugaaccggagagagaaaaguccgcugccaucgacggcgaguaccgccugagaggggaagcgcggaaaacauucgucgagcucaugcgcagaggcgaucuucccguguggcugucuuauaaggucgccagcgagggauuucaguacuccgaccggcgcuggugcuucgauggcgaaagaaauaaccaggugcuggaggaaaauauggacguugagauuuggaccaaagaaggggagcggaagaaacucagaccucgcuggcuggacgcucggacguauagcgauccccuugcccugagagaguuuaaggaauucgcugccggacgccggucuguguccggcgaccucauccuggagauugggaaacugccucaacaccucacacuuagagcucagaacgcccuggauaaucuggugaugcuccacaacagcgaacagggaggcaaggcguaccggcaugccauggaggaacugcccgacaccaucgagacccuuaugcugcucgcucugauugccguccugacaggcgggguuacccucuuuuuccuuuccggaaagggccuggggaaaacaucuaucggacugcucugugugacggcuagcuccgcccugcuuuggauggccucuguggagccgcacuggaucgcugcgagcauuauccuggaauuuuuccucaugguccugcugauuccugagcccgaucgccagagaaccccucaagacaaucagcucgccuaugugguuaucggccuucuguuuaugauucugacaguggcugccaacgaaauggggcuccuggagaccacaaagaaagaucuuggaaucggcuacgccgcugccgagaaccaucagcacgcgaccaugcuggacgucgaucuccggcccgccuccgcuuggacgcuguacgccguggcuaccacagucaucaccccuaugaugcgccacacaauugaaaauaccacggccaacaucagccugacagcgauugccaaucaagcugccauccucaugggccuugacaagggguggcccauuucuaaaauggauaucggagugccgcugcuggcucucggcugcuauucccagguuaacccucugacccuuacagccgcugugcugaugcucgucgcccauuacgcgauuaucgggcccggacugcaggccaaggcuaccagagaggcccagaagcggaccgcugccggcaucaugaaaaaucccacaguggacgggauuguugccaucgaucuggacccuguggucuaugacgcgaaguucgaaaaacaacucggacagauuaugcuucugauccuguguacgagccagauucuccugaugcgcaccacaugggcucuuugcgagucuaucacccuggccacaggcccgcucaccacgcugugggaaggcucccccgggaaguuuuggaacacaaccaucgcugugagcauggccaauauuuucagaggaucuuaccuggccggcgcugggcucgccuucagccuuaugaaaucccugggaggcgggcggcgcggaaccggcgcgcagggcgagacacugggggagaaguggaagagacaacucaaccagcugucuaaaagcgaauuuaauaccuauaagcgguccggaaucauggagguggauagaagcgaagccaaagagggccuuaagcgcggggaaacaacgaaacacgcuguuucccggggaaccgccaagcugagaugguucgucgagcgcaaccucgugaagccugagggcaaagugauugaccugggguguggacggggcggcuggucuuacuauugcgcugggcugaagaaagucacagaaguuaagggauacaccaaaggcgggcccggacaugaggaaccuauccccauggccacauacggcuggaaucucgugaagcuucacagcgggaaagauguguuuuucaugccuccggagaagugugacacccugcugugcgauauuggagaauccucucccaacccuacgaucgaggagggcagaacccuccgcguccugaagaugguggaacccuggcuucggggcaaucaguuuuguaucaaaauucugaacccuuauaugcccagcguuguggagacacucgaacagaugcaaagaaagcaugggggaaugcugguccgcaauccgcugucccggaacucuacccacgagauguacugggugagcugcggcacagggaauaucguuuccgcggugaacaugaccagcagaaugcuccugaaccgcuucacaauggcccaccggaaaccuaccuaugagagagacgucgaucuuggagcuggcacgcgccauguggccguggaacccgaggucgcuaaucuggacauuaucgggcagagaauugaaaacaucaagaaugagcacaaaucuacauggcauuacgaugaagacaaccccuauaagaccugggccuaccacggauccuaugagguuaagccuagcggcucugcuuccagcauggugaauggcgugguccggcuccugaccaaacccugggaugugauuccuaugguuacacagaucgccaugacggacaccacaccguuugggcaacagcgcguguucaaggagaaagucgacaccagaacaccccgggcgaagagaggaaccacacagaucauggaagugaccgccaaauggcuuuggggcuuucugucucggaacaagaagccucgcauuuguacgagagaggaauucacccggaaaguucgcuccaaugcugccaucggggcuguguuugucgaugagaaccaguggaauagcgccaaggaagccguggaggacgagagauucugggaucucguucaccgggaacgcgagcugcauaaacaaggaaagugcgcgacaugcguguacaacaugaugggcaaaagagaaaagaagcugggggaguuuggcaaagcuaagggaucccgggccauuugguacauguggcucggcgcccgcuuccuggaauucgaggcucuuggguuuaugaaugaggaccacugguucagcagagaaaacucucugagcggagucgagggcgaagggcuccauaaacugggauauauccuucgggauauuuccaagauccccggcgggaauauguacgccgacgauaccgcuggcugggacacacgcaucaccgaggaugaccugcagaacgaggccaaaauuacggauaucauggaaccugagcacgcgcuccuggccacaucuauuuuuaagcugaccuaucagaauaaaguggucagagugcagcggcccgcuaagaacggaacaguuauggacgugaucagccgcagagaucaacggggcuccgggcaggucggaaccuacggccucaacacguucaccaauauggaagugcagcugauuagacagauggagucugaagggaucuuucuuccgagcgagcuggagacaccuaaccucgccgaacgcgugcuggacuggcuugagaagcauggagcugaacggcugaaaagaauggccaucuccggcgacgauuguguugugaagcccauugacgaucgcuucgcgaccgcccucacagcucugaaugacauggggaaaguccggaaggauaucccucaaugggagcccucuaaaggcuggaacgacuggcagcaggugccuuuuugcagccaccacuuccaucagcugauuaugaaggauggaagagaaaucguugugcccugucgcaaucaagacgagcucgucggccgggccagagugucccagggggcuggauggagccugcgcgagaccgccugccuuggcaagucuuaugcucagauguggcaacugauguacuuucaccggagagaucuccgccuggccgcgaacgccauuuguuccgcugucccgguggaauggguuccuacaagccggaccacguggucuauccaugcccaccaccaguggaugacaaccgaggacaugcuuuccguguggaauagagucuggaucgaagagaaccccuggauggaagauaaaacccaugugagcuccugggaggagguucccuaucuggggaagcgggaagaccaguggugcggaucucucauuggccugacagccagagcuaccugggccacaaauauccagguggcgauuaaccaaguccgccggcugaucgggaaugagaacuaccucgacuacaugacgagcaugaaaagauucaagaaugaauccgauccugagggcgcucugugguga

SEQ ID NO: 18514 - RNA, 9879 nt, Artificial Sequence
  derived and/or modified CDS sequence (opt5) from DENV-1__GQ868568__SS-prME
agcgugaccaugcugcucaugcugcuucccaccgcucuggcuuuccaccucacgaccagaggcggggaaccucauaugaucgucuccaagcaggaacggggaaagucucugcuuuuuaagacaagcgccggcguuaauaugugcacccugauugcgauggaccucggggaacugugugaagauacaaugaccuacaagugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcccuucgccaccccggcuucaccgugaucgcccuguuucucgcgcaugucauugggacaucuaucacccagaagggaaucauuuucauccugcuuaugcuggugaccccuagcauggccaugagaugcguuggcauugggaaucgggauuuuguggagggacucuccggcgcuacaugggucgacguggugcuggagcacgggagcugugucacgaccauggccaagaauaaacccacacuggauaucgaacuccugaagaccgagguuacaaacccugcugugcuucgcaaacugugcauugaagccaagaucucuaauaccacgacagacuccagauguccgacccaaggagaggcgacccucguggaagaacaggaugccaacuucgucugccggcgcacauuuguggacagaggcuggggcaauggguguggacuguucggcaaagggagccuucugaccugcgcuaaguuuaagugcguuacaaaacucgagggaaagauugugcaguacgaaaaccugaaauauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagcccccggacaggccuugauuucaacgaaaugguccugcucaccaugaaggagaaaucuuggcuggugcauaagcagugguuucuugaccugccucuccccuggacguccggggccagcacaucccaagagaccuggaaucgccaggaucugcuggucacauucaaaaccgcucacgcgaagaagcaggaagugguugugcucggaucucaagagggcgccaugcacaccgcucugacaggggccacggaaauucagaccagcggaacaaccacaaucuuugccggccaucuuaaaugcagacugaagauggacaaacucacccugaaggggauguccuaugucauguguacgggcagcuucaaacuggagaaggaaguggcugagacacagcacggaaccguucuugugcaggucaaguacgagggcaccgaugccccgugcaaaauuccuuucucuacacaagacgaaaagggggugacccagaacggacggcucaucacagcgaaucccaucgugacggauaaagagaagccuguuaacauugaaaccgagccgcccuuuggcgaguccuauaucgucgugggggcuggagaaaaagcccugaagcugagcugguucaagaaaggcucuagcauugggaagauguuugaggccacagcuagaggcgcccgccggauggcuauccucggagacaccgccugggauuucggcuccauugggggaguguuuacaucugucggcaaacuggugcaucagguuuucgggaccgcguacggagugcuuuuuagcggcgucuccuggaucaugaagaucgggauuggcauccugcucacguggcugggacugaauagcagaucuaccucccuuagcaugacauguauugccgugggcaugguuacccucuaccugggggugaugguccaggcugacucuggaugcgugaucaacuggaaaggccgcgaacugaaguguggguccggaauuuucguuacaaacgaggugcacaccuggacagaacaauauaaguuucaggccgauagcccuaaacggcucuccgcugccaucggcaaggcgugggaggagggggucugcggcauuagaucugccacccgccuggaaaauaucauguggaaacagaucagcaacgagcuuaaucauauucugcucgaaaacgacaugaaguucacggugguggucggagacgcuaauggcauccuggcccaggggaaaaagaugauucggccgcaacccauggagcacaaauacuccuggaagucuuggggaaaggcuaaaaucauuggcgccgauacacagaacaccaccuuuaucaucgacgggccugauacacccgaauguccugacggacagagagccuggaauauuugggagguugaggauuauggcuucggcaucuuuaccacgaacauuuggcugaaacuucgcgacagcuacacacagaugugcgaucaccggcucauguccgcugcgaucaaagacagcaaggccgugcaugcugauaugggguauuggauugaaucugagaaaaaugaaaccuggaagcuggccagagccuccuucaucgaggugaagacauguaccuggcccaaaagccacacacuguggucuaacggaguccucgaauccgagaugaucauuccgaagaucuacggcgggccuauuagccaacauaauuaucgccccggauacuucacccagacggcuggcccuuggcaccuggggaaacuugagcuggacuuugaucucugcgaaggaaccacagugguuguggacgagcacugcggcaaccggggccccucucugagaaccacaaccgucacggggaagaucauucaugaaugguguugccggagcuguacacugccuccccuucgcuucagaggagaggauggcugcugguacgggauggagauccggccggugaaagaaaaggaggaaaaucucguuagauccauggugagcgccggaucuggcgaggucgacuccuuuagccuggggauccuguguguguccauuaugaucgaagagguuaugcgcucucgguggagcagaaagaugcucaugaccggaacacuggcgguguuccuucugcucauuaugggccagcugaccuggaacgaccugacccgccuuugcaucauggucggcgcuaaugccuccgauagaauggggaugggaacaacguaucuggcccucauggcuaccuuuaaaaugcggccuauguucgccgugggccugcucuuucgcagacugacaucucgggaggugcuucugcucaccauugggcugagccuggucgcguccguugaacuucccaacucucuggaggaacucggagacggccuggcuauggggaucaugaugcucaagcugcuuacagaguuccaaccccaccagcuguggaccacgcuccugagccugacauuugugaaaaccacccuuucccuggauuacgccuggaagacaaccgccauggugcucagcauugucucucuguucccucucugucuguccacaacgagccagaaaaccacauggcuuccggugcugcugggaucuuuuggcugcaagccccucaccauguuccugaucacagaaaacaagaucuggggccgcaaauccuggccucuuaaugaggggauuauggcuaucggaauuguuagcauccugcucucuucccugcucaagaacgacgugccccuggccggcccucuuauugcugggggaaugcugaucgccuguuaugucaucagcggcuccagcgcggaucugucucucgagaaagccgcugaagugagcugggagcaggaagccgagcauuccggggcuucucacaauauucugguugaagugcaagacgauggaaccaugaagaucaaagacgaggagagagaugacacgcuuaccauucugcucaaggccacacugcucgccgucagcggcguguaccccauguccaucccugcuacccuguuugucugguauuucuggcagaaaaagaagcagcggucuggcgugcuuugggauacacccagcccgccugaaguugagcgcgcggugcuggacgaugggauuuacagaauccugcagcggggacuccugggccgcucccaagucggggugggaguuuuccaggacggcguguuucauaccauguggcacgucacaagaggggccgugcuuauguaucagggaaaacggcuggaacccucuugggcuagcgugaagaaagaccucaucuccuacggcggcggguggagauuccagggaagcuggaacacgggcgaggagguucaagucauugccguggaaccugggaagaaucccaaaaacgugcagaccacaccgggaaccuuuaagaccccugagggcgaagucggggccaucgcucuggauuucaagcccggaacaucuggcuccccuauugugaaucgcgagggcaaaaucguugggcucuacggaaacggcguggucacgaccagcgggacauaugugucugccauugcgcaggcuaaggccucccaagaaggaccccugcccgagaucgaggacgaaguuuuuaaaaagcggaaucuuaccauuauggaucugcacccuggcagcgggaaaacaagacgcuaccugccggccaucgugcgggaggcuaucaagagaaagcuccgcacccugauucuugcccccacgcgggucguggcguccgaaauggcugaggcccugaaaggcaugccuaucagauaucagacaaccgccguuaagucugaacauaccggacgcgagauuguggaccucaugugccacgcuacauucaccaugcggcugcugagccccgucagagugccuaacuacaauaugaucauuauggaugaggcccauuuuacagaccccgcuuccaucgccgcgcggggcuauaucagcacccgcguggggaugggagaagccgcugccauuuucaugacggcuacaccuccgggcucugucgaggccuuuccccaguccaacgccguuauccaggaugaagagagagacauuccugaacggagcuggaacucuggguacgauuggaucaccgacuuccccggaaaaacagugugguuugugccuagcauuaaguccggcaacgauaucgcuaauugucuccgcaaaaacgggaagagagucauccaacuuucucggaagaccuucgacacggaguaucagaaaaccaagaacaaugacugggauuacgugguuacaaccgacauuagcgagaugggcgcgaacuucagagccgaucgcgugaucgacccccggagaugccugaaaccggucauucugaaggauggaccugaacgcgugauccucgcuggccccaugcccguuacaguggccuccgccgcucagcggagagggcgcauuggacggaaucagaacaaagagggcgaccaauacgucuauauggggcagccucugaauaacgaugaagaccacgcccauuggaccgaggcgaagaugcuucuggauaauaucaacacacccgagggaauuaucccugcucucuuugaaccggagagagaaaagucugccgccguggacggcgaguaccgccugagaggggaagcucggaaaaccuucgucgagcugaugcgcagaggcgaucuccccguguggcuuagcuauaagguugccuccgagggauuucaguacagcgaccggcgcuggugcuucgauggcgaaagaaauaaccaggugcuggaggaaaauauggacguggagaucuggacgaaagaaggggagcggaagaaacugagaccucgcuggcucgacgcgcggacauauucugauccccuggcccuuagagaguuuaaggaguucgcugccggacgccgguccgucagcggcgaccugauucucgagaucgggaaacugccucaacaccugacccucagagcucagaacgcccuugauaaucugguuaugcugcacaacuccgaacagggaggcaaggcuuaccggcaugccauggaggaacuccccgacaccauugagacacugaugcuucuggcgcucaucgccgugcugaccggcggggugacacuguuuuuccucucuggaaagggccuugggaaaacgagcauuggacugcugugugucaccgcuuccucugcccuccuguggauggcuagcguggagccgcacuggaucgccgccuccaucauucuugaauuuuuccugaugguucuccugaucccugagcccgaucgccagagaacaccucaagacaaucagcuggcuuauguggucauuggccuccuuuuuaugauccugaccguggcggccaacgaaauggggcugcucgagacaaccaagaaagaucugggaauuggcuacgucgcugccgagaaccaucagcacgccacgaugcuugacguggaucugcggcccgcuagcgccuggacccucuacgcgguugccacaaccgugaucacaccuaugaugcgccacaccaucgaaaauacgacagcuaacauuucucugaccgccaucgcuaaucaagccgcgauucugaugggccucgacaagggguggcccaucuccaaaauggauauuggagucccgcuucuggcccugggcugcuauagccaggugaacccucucacacugaccgcugccguucuuaugcugguggcucauuacgccaucauugggcccggacuccaggcuaaggccaccagagaggcgcagaagcggacagccgcuggcaucaugaaaaaucccacggucgacgggaucguggccauugaucuggacccugugguuuaugacgcuaaguucgaaaaacaacugggacagaucaugcuccuuauucuguguaccucucagauccugcucaugcgcacaaccugggcccugugcgaguccauuacacuugccaccggcccgcugacgacacucugggaaggcagccccgggaaguuuuggaacaccaccaucgcggucucuauggcuaauaucuucagaggaagcuaccuggccggcgcugggcuggccuucucccucaugaaaucucuuggaggcgggcggcgcggaacaggcgcccagggcgagacccugggggagaaguggaagagacaacugaaccagcucagcaaauccgaauuuaauacauauaagcggagcggaauuauggagguggauagauccgaagcuaaagagggccugaagcgcggggaaacgaccaaacacgccgugucucggggaacagcgaaacuuagaugguucgucgagcgcaaccugguuaagccugagggcaaagugaucgaccucggguguggacggggcggcuggagcuacuauugcgccgggcugaagaaagugaccgaagucaagggauacacaaaaggcgggcccggacaugaggaaccuauucccauggcuaccuacggcuggaaucuggugaagcuccacuccgggaaagauguguuuuucaugccuccggagaagugugacacgcuucugugcgauaucggagaaucuagccccaacccuaccauugaggagggcagaacacugcgcguucucaagauggucgaacccuggcugcggggcaaucaguuuuguaucaaaauccuuaacccuuauaugcccuccgugguugagacccuggaacagaugcaaagaaagcaugggggaaugcucgugcgcaauccgcugucucggaacagcacacacgagauguacugggucuccugcggcaccgggaauauugugagcgccgugaacaugacaucuagaaugcugcucaaccgcuucaccauggcucaccggaaaccuacguaugagagagacgucgaucugggagccggcacacgccauguugcgguggaacccgagguggccaaucuugacaucauugggcagagaaucgaaaacauuaagaaugagcacaaauccaccuggcauuacgaugaagacaaccccuauaagaccugggcuuaccacggaagcuaugaggucaagccuucuggcuccgccagcucuauggugaauggcguugugcggcugcucacaaaacccugggaugucaucccuauggugacgcagauugcuaugaccgacacaaccccguuugggcaacagcgcguuuucaaggagaaaguggacacaagaacaccccgggccaagagaggaacaacccagaucauggaagucacggcuaaauggcuguggggcuuucuuucccggaacaagaagccucgcaucuguaccagagaggaguucacacggaaagugcgcagcaaugccgcgauuggggccguuuuuguggaugagaaccaguggaacuccgcuaaggaagccgucgaggacgagagauucugggaucuggugcaccgggaacgcgagcuccauaaacaaggaaagugcgcuaccugcgucuacaacaugaugggcaaaagagaaaagaagcugggggaguuuggcaaagccaagggaagccgggccaucugguacauguggcugggcgcgcgcuuccucgaguucgaggcucugggguuuaugaaugaggaccacugguucucuagagaaaacagccuuuccggaguggagggcgaagggcugcauaaacucggauauauucugcgggauaucucuaagauucccggcgggaauauguacgccgacgauacagccggcugggacacccgcaucacggaggaugaccuucagaacgaggcuaaaaucacagauauuauggaaccugagcacgcccugcucgcuaccagcaucuuuaagcugacauaucagaauaaaguugugagaguccagcggcccgccaagaacggaaccgugauggacgugauuucccgcagagaucaacggggcucugggcagguuggaacguacggccugaacaccuucacaaauauggaagugcagcucaucagacagauggagagcgaagggauuuuucugccguccgagcuugagaccccuaaccuggcggaacgcguccucgacuggcuggagaagcauggagccgaacggcuuaaaagaauggcuaucucuggcgacgauugugugguuaagcccaucgacgaucgcuucgccacagcucugaccgcccucaaugacauggggaaagugcggaaggauauuccucaaugggagcccagcaaaggcuggaacgacuggcagcaggucccuuuuugcucccaccacuuccaucagcugaucaugaaggauggaagagaaauugugguccccugucgcaaucaagacgagcuggugggccgggcgagaguuagccagggggccggauggucucuccgcgagacagcuugccugggcaaguccuaugcccagauguggcaacuuauguacuuucaccggagagaucugcgccucgcugccaacgcuaucuguagcgccgugccggucgaaugggugccuaccucucggacgacaugguccauucaugcgcaccaccaguggaugaccaccgaggacaugcugagcguuuggaauagaguguggaucgaagagaaccccuggauggaagauaaaacacaugucuccucuugggaggaggugcccuaucuugggaagcgggaagaccaguggugcggaagccugaucggccucaccgccagagcuacaugggccacgaauauucagguggccaucaaccaaguucgccggcugauugggaaugagaacuaccuggacuacaugaccuccaugaaaagauucaagaaugaaagcgauccugagggcgcucucugguga

SEQ ID NO: 18515 - RNA, 9879 nt, Artificial Sequence
  derived and/or modified CDS sequence (opt5) from DENV-1__GQ868569__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucgccaacccugcgguucuucgcaaacugugcauugaagccaagaucucuaauacaaccacggacuccagauguccgacacaaggagaggcuacccucguggaagagcaggaugccaacuucgugugccggcgcaccuuugucgacagaggcuggggcaauggguguggacuguucggcaaagggagccuucugacaugcgcuaaguuuaagugcgugaccaaacucgagggaaagauuguucaguacgaaaaccugaaauauucugugaucgucacagugcacacgggcgaucagcaucaaguugggaaugagaccacagaacacggaaccaucgccacaauuaccccccaggccccuacguccgagauccagcugaccgacuacggcgcucucacacuggacuguagcccccggaccggccuugauuucaacgaaauggugcugcucacaaugaaggagaaaucuuggcugguccauaagcagugguuucuugaccugccucuccccuggaccuccggggcgagcacgucccaagagacauggaaucgccaggaucugcuggugaccuucaaaacagcccacgcuaagaagcaggaagucgugguucucggaucucaagagggcgccaugcacaccgcccugaccggggcuacagaaauucagacgagcggaaccacaaccaucuuugccggccaucuuaaaugcagacugaagauggacaaacucacacugaaggggauguccuaugugauguguaccggcagcuucaaacuggagaaggaagucgcggagacgcagcacggaacagugcuuguucaggugaaguacgagggcaccgaugcuccgugcaaaauuccuuucucuacccaagacgaaaagggggucacacagaacggacggcucaucaccgccaaucccaucgugacagauaaagagaagccugugaacauugaaacggagccccccuuuggcgaguccuauaucguugucggggccggagaaaaagcucugaagcugagcugguucaagaaaggcucuagcauugggaagauguuugaggccaccgcuagaggcgcccgccggauggcgauccucggagacacagccugggauuucggcuccauugggggaguguuuaccucugugggcaaacugguccaucagguguucgggacagcuuacggaguucuuuuuagcggcguguccuggaccaugaagaucgggaucggcauucugcucacguggcugggacugaauagcagaucuaccucccuuagcaugacauguaucgccgucggcauggugacccucuaccuggggguuauggugcaggcugacucuggaugcgucauuaacuggaaaggccgcgaacugaaguguggguccggaaucuucgugacaaacgagguucacaccuggacagaacaauauaaguuucaggccgauagcccuaaacggcucuccgcggccauuggcaaggcuugggaggagggggugugcggcaucagaucugccacccgccuggaaaauauuauguggaaacagaucagcaacgagcuuaaucauauccugcucgaaaacgacaugaaguucacggucguggugggagacgcuaauggcauucuggcccaggggaaaaagaugauccggccgcaacccauggagcacaaauacuccuggaagucuuggggaaaggccaaaauuaucggcgcugauauucagaacgcgacauuuaucaucgacgggccugauacccccgaauguccugacggacagagagccuggaauauuugggaggucgaggauuauggcuucggcaucuuuaccacaaacauuuggcugaagcuucgcgacagcuacacccagaugugcgaucaccggcucauguccgcugccaucaaagacagcaaggccguucaugcugauaugggguauuggauugaaucugagaaaaaugaaacguggaagcuggccagagcguccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacagcuggcccuuggcaccuggggaaacuugagcuggacuuugaucucugcgaaggaaccacggucgugguugacgagcacugcggcaaccggggccccucucugagaaccacaaccgugacagggaagaucauucaugaaugguguugccggagcuguacccugccuccccuucgcuucagaggagaggauggcugcugguacgggauggagauccggccggucaaagaaaaggaggaaaaucucgugagauccaugguuagcgccggaucuggcgagguggacuccuuuagccuggggauccugugugucuccauuaugaucgaagaggugaugcgcucucgguggagcagaaagaugcucaugacgggaacacuggccguuuuccuucugcucauuaugggccagcugaccuggaacgaccugacacgccuuugcaucauggugggcgcuaaugccuccgauagaauggggaugggaaccaccuaucuggcgcucauggcuacauuuaaaaugcggccuauguucgccgucggccugcucuuucgcagacugacgucucgggaggugcuucugcucaccauugggcugagccugguggccuccgucgaacuucccaacucucuggaggaacucggagacggccuggcuauggggaucaugaugcucaagcugcuuacagaguuccaaccccaccagcuguggaccacacuccugagccugaccuuuguuaaaacgacacuuucccuggauuacgccuggaagaccaccgcuauggugcucagcauugugucucuguucccucucugucuguccacaaccagccagaaaacaacguggcuuccgguccugcugggaucuuuuggcugcaagccccucaccauguuccugaucacagaaaacaagaucuggggccgcaaauccuggccucuuaaugaggggauuauggccaucggaauugugagcauccugcucucuucccugcucaagaacgacguuccccuggcgggcccucuuauugccgggggaaugcugaucgcuuguuaugugaucagcggcuccagcgccgaucugucucucgagaaagcugccgaagucagcugggagcaggaagccgagcauuccggggcuucucacaauauucugguggaaguucaagacgauggaaccaugaagaucaaagacgaggagagagaugacacacuuaccauucugcucaaggcgacgcugcucgccgugagcggcgucuaccccauguccaucccugcuacccuguuugugugguauuucuggcagaaaaagaagcagcggucuggcguccuuugggauacacccagcccgccugaaguggagcgcgccguucuggacgaugggauuuacagaauccugcagcggggacuccugggccgcucccaagugggggucggaguguuccaggacggcguuuuucauaccauguggcacgugacaagaggggccguccuuauguaucagggaaaacggcuggaacccucuugggcuagcgugaagaaagaccucaucuccuacggcggcggguggagauuccagggacuguggaacaugggcgaggaggugcaaguuauugccgucgaaccugggaagaauccccgcaacgugcagaccacaccgggaacguuuaaaaccccugagggcgaagugggggcgaucgcucucgauuucaagcccggaacaagcggcucuccuauugucaaucgggagggcaagaucguggggcuguacggaaacggcguugugaccaccuccgggacauaugucagcgccauugcccaggcuaaagccucucaagaaggaccccuucccgagaucgaggacgaaguguuuaagaaaagaaaucugacgauuauggaucugcacccuggcuccgggaagacccgccgguaccucccggcgaucguuagagaggcuaucaaacgcaagcugcggacacuuauucuggcccccaccagaguggucgccagcgaaauggcugaggcccucaagggcaugccuauccgcuaucagacaaccgcugugaaauccgaacauacgggacgggagauuguugaccugaugugccacgccacauucaccaugagacugcucucucccgugcgggucccuaacuacaauaugaucauuauggaugaggcgcauuuuaccgaccccgccagcaucgcugcccgcggcuauaucuccacaagaguggggaugggagaagcugccgccauuuucaugaccgcuacaccuccgggcagcguggaggcguuuccccagucuaacgccgucauccaggaugaagagcgggacauuccugaacgcuccuggaauagcggguacgauuggaucaccgacuuccccggaaagacgguuugguuugugccuucuauuaaaagcggcaacgauaucgcuaauugucuuagaaagaacgggaaacgggugauccaacuguccagaaagacauucgacaccgaguaucagaagacaaaaaacaaugacugggauuacgucgugaccacggacauuucugagaugggcgccaacuuccgcgccgaucggguuaucgaccccagacgcugccugaagccggugauucucaaagauggaccugaacgggucauccuggcuggccccaugcccgugaccguugccagcgcggcucagagacgcgggcggauuggaagaaaucagaacaaggagggcgaccaauacguguauauggggcagccucuuaauaacgaugaagaccacgcccauuggacagaggccaaaaugcugcucgauaauaucaacacccccgagggaauuaucccugcucuguuugaaccggagcgcgaaaaguccgccgcgaucgacggcgaguacagacugcggggggaagcccgcaagacauucgucgagcucaugagacggggcgaucuucccguguggcugucuuauaaagucgcuagcgagggauuucaguacuccgaccgcagauggugcuucgauggcgaacggaauaaccaggugcuggaggaaaauauggacguugagauuuggaccaaggaaggggagagaaaaaagcuccgcccucgguggcuggacgccagaacauauagcgauccccuugcucugcgcgaguuuaaagaauucgccgcuggacggagaucuguguccggcgaccucauccuggagauugggaagcugccucaacaccucacccuucgggcccagaacgcgcuggauaaucuggugaugcuccacaacagcgaacagggaggcaaagccuaccgccaugcuauggaggaacugcccgacacgaucgagacacuuaugcugcucgcccugauugcuguccugaccggcgggguuacccucuuuuuccuuuccggaaagggccuggggaagacaucuaucggacugcucugugugaccgccagcuccgcccugcuuuggauggcuucuguggagccgcacuggaucgcggccagcauuauccuggaauuuuuccucaugguccugcugauuccugagcccgauagacagcggacaccucaagacaaucagcucgcuuaugugguuaucggccuucuguuuaugauucugacgguggccgccaacgaaauggggcuccuggagaccacaaaaaaggaucuuggaaucggcuacgcugccgcggagaaccaucagcacgccaccaugcuggacgucgaucuccgccccgcuuccgccuggacacuguacgcuguggccaccacggucaucaccccuaugaugagacacacaauugaaaauaccacagcgaacaucagccugaccgccauugcuaaucaagccgcuauccucaugggccuugacaaaggguggcccauuucuaagauggauaucggagugccgcugcuggcccucggcugcuauucccagguuaacccucugacgcuuacagcugccgugcugaugcucgucgcgcauuacgccauuaucgggcccggacugcaggcuaaagccacccgggaggcucagaagcgcacagccgccggcaucaugaagaaucccaccguggacgggauuguugcgaucgaucuggacccuguggucuaugacgcuaaauucgaaaagcaacucggacagauuaugcuucugauccuguguaccagccagauucuccugaugagaacaacgugggcccuuugcgagucuaucacccuggcuacaggcccgcucaccacacugugggaaggcucccccgggaaauuuuggaacaccacgaucgccgugagcauggccaauauuuuccggggaucuuaccuggcuggcgccgggcucgcguucagccuuaugaagucccugggaggcgggcgcagaggaacaggcgcccagggcgagacccugggggagaaauggaagcggcaacucaaccagcugucuaagagcgaauuuaauaccuauaaaagauccggaaucauggagguggaucgcagcgaagcuaaggagggccuuaaacggggggaaacaaccaagcacgccguuuccagaggaacagcuaaacugcgcugguucgucgagcggaaccucgugaagccugagggcaaggugauugaccugggguguggaagaggcggcuggucuuacuauugcgccgggcugaaaaaggucacggaaguuaaaggauacaccaagggcgggcccggacaugaggaaccuauccccauggcgacauacggcuggaaucucgugaaacuucacagcgggaaggauguguuuuucaugccuccggagaaaugugacacccugcugugcgauauuggagaauccucucccaacccuacaaucgaggagggccgcacccuccggguccugaagaugguggaacccuggcuuagaggcaaucaguuuuguaucaagauucugaacccuuauaugcccagcguuguggagacgcucgaacagaugcaacgcaaacaugggggaaugcugguccggaauccgcuguccagaaacucuacccacgagauguacugggugagcugcggcacagggaauaucguuuccgccgugaacaugaccagccgcaugcuccugaaccgguucacaauggcucacagaaagccuaccuaugagcgcgacgucgaucuuggagccggcacaagacauguggcuguggaacccgaggucgccaaucuggacauuaucgggcagcggauugaaaacaucaaaaaugagcacaagucuaccuggcauuacgaugaagacaaccccuauaaaacgugggcuuaccacggauccuaugagguuaagccuagcggcucugccuccagcauggugaauggcgugguccgccuccugacaaagcccugggaugugauuccuaugguuacccagaucgcgaugaccgacacaacgccguuugggcaacagagaguguucaaagagaaggucgacacccggacacccagagccaaacggggaaccacacagaucauggaagugaccgcuaaguggcuuuggggcuuucugucucgcaacaaaaagccuagaauuuguacacgggaggaauucacccgcaagguuagauccaaugccgcuaucggggccguguuugucgaugagaaccaguggaauagcgccaaagaagcgguggaggacgagcgguucugggaucucguucaccgcgaaagagagcugcauaagcaaggaaaaugcgcuacgugcguguacaacaugaugggcaagcgggaaaaaaagcugggggaguuuggcaaggccaaaggaucccgcgccauuugguacauguggcucggcgcuagauuccuggaauucgaggcccuuggguuuaugaaugaggaccacugguucagccgggaaaacucucugagcggagucgagggcgaagggcuccauaagcugggauauauccuucgcgauauuuccaaaauccccggcgggaauauguacgcugacgauaccgccggcugggacacaagaaucaccgaggaugaccugcagaacgaggcgaagauuacagauaucauggaaccugagcacgcccuccuggcuaccucuauuuuuaaacugacguaucagaauaaggugguccgggugcagcgccccgccaaaaacggaacaguuauggacgugaucagcagacgggaucaaagaggcuccgggcaggucggaaccuacggccucaacacauucaccaauauggaagugcagcugauucgccagauggagucugaagggaucuuucuuccgagcgagcuggagacgccuaaccucgcugaacgggugcuggacuggcuugagaagcauggagccgaaagacugaagcgcauggcgaucuccggcgacgauuguguugugaaacccauugacgaucgguucgccaccgcucucacagcccugaaugacauggggaaggucagaaaagauaucccucaaugggagcccucuaagggcuggaacgacuggcagcaggugccuuuuugcagccaccacuuccaucagcugauuaugaaagauggacgcgaaaucguugugcccugucggaaucaagacgagcucgucggcagagcucgcgugucccagggggccggauggagccugcgggagaccgcuugccuuggcaagucuuaugcccagauguggcaacugauguacuuucacagacgcgaucuccggcuggcggccaacgcuauuuguuccgccgucccgguggaauggguuccuacaagcagaaccacauggucuauccaugcccaccaccaguggaugaccacggaggacaugcuuuccguguggaaucgggucuggaucgaagagaaccccuggauggaagauaagacacaugugagcuccugggaggagguucccuaucuggggaaaagagaagaccaguggugcggaucucucauuggccugaccgcucgcgccaccugggcgacaaauauccagguggcuauuaaccaaguccggagacugaucgggaaugagaacuaccucgacuacaugaccagcaugaagcgcuucaaaaaugaauccgauccugagggcgcccugugguga

SEQ ID NO: 18516 - RNA, 9879 nt, Artificial Sequence
  derived and/or modified CDS sequence (opt5) from DENV-1__GQ868570__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaaggucgggaucggcauccugcucaccuggcugggacugaauagcagaucuacaucccuuagcaugaccuguauugcugugggcaugguuacacucuaccugggggugaugguccaggccgaccugggaugcgugaucaacuggaaaggccgcgaacucaagugugggucuggaauuuucguuaccaacgaggugcacacauggaccgaacaauauaaguuucaggcugauuccccuaaacggcugagcgccgcgaucggcaaggccugggaggagggggucugcggcauuagauccgugacgcgccuugaaaauaucauguggaaacagauuucuaacgagcugaaucauauccuccuggaaaacgacaugaaguucacaguggucguuggagacgcuaauggcauccuggcccaggggaaaaagaugauucggccgcaacccauggagcacaaauacagcuggaaguccuggggaaaggcuaaaaucauuggcgccgauacccagaacaccacauuuaucauugacgggccugauacccccgaauguccugacggacagagagccuggaauaucugggagguggaggauuauggcuucggcaucuuuacgacaaacauuuggcuuaagcuccgcgacucuuacacccagaugugcgaucaccggcugaugagcgcugcgaucaaagacuccaaggccgugcaugcugauaugggguauuggauugaaagcgagaaaaaugaaacauggaagcuggccagagccucuuucaucgaggucaagaccuguacauggcccaaaucccacacccucuggagcaacggagugcuggaaucugagaugauuaucccgaagaucuacggcgggccuauuucccaacauaauuaucgccccggauacuucacgcagaccgcuggcccuuggcaccuugggaaacuggagcucgacuuugaucugugcgaaggaacaaccguuguggucgacgagcacugcggcaaccggggccccagccugagaacaaccacggugacagggaagaucauucaugaaugguguugccggucuuguacccuuccuccccuccgcuucagaggagaggauggcugcugguacgggauggagauccggccgguuaaagaaaaggaggaaaaucuggugagaagcauggucuccgccggaagcggcgagguggacucuuuuucccuggggauucucuguguuagcaucaugaucgaagaggugaugcgcucccgguggucuagaaagaugcugaugacaggaacccuugcggucuuccugcuccugauuaugggccagcugaccuggaacgaccuuauccgccugugcauuauggugggcgcuaaugccagcgauagaauggggaugggaacaacguaucucgcccugauggcuaccuuuaaaaugcggccuauguucgccgugggccuccuguuucgcagacuuacaucccgggagguccugcuccugaccaucgggcugucucuuguugcgagcguggaacugcccaacucccucgaggaacugggagacggccucgcuauggggauuaugaugcugaagcuucugacagaguuccaaccccaccagcucuggaccacgcugcugucucuuacauuugugaaaaccacccugagccucgauuacgccuggaagacaaccgccaugguccuguccaucgugagccucuucccucugugucuuucuacaacgucccagaaaaccacauggcugccgguucugcucggaagcuuuggcugcaagccccugaccauguuccuuauuacagaaaacaagaucuggggccgcaaaucuuggccucugaaugaggggaucauggcuauuggaaucguguccauucuccugagcucucuccugaagaacgacgucccccuugccggcccucugaucgcugggggaaugcugauugccuguuaugugaucuccggcagcuccgcggaucucagccuggagaaagccgcugaaguuucuugggagcaggaagccgagcauagcggggcuucccacaauauccuuguggaaguccaagacgauggaaccaugaagauuaaagacgaggagagagaugacacgcugaccauccuccugaaggccacacuccuggccgugucuggcgucuaccccaugagcauuccugcuacccuuuuugugugguauuucuggcagaaaaagaagcagcgguccggcguucugugggauacacccucuccgccugaaguggagcgcgcgguccuggacgaugggaucuacagaauucuccagcggggacugcuuggccgcagccaaguggggguuggaguguuccaggacggcgucuuucauaccauguggcacgugacaagaggggccgugcugauguaucagggaaaacggcucgaacccuccugggcuucuguuaagaaagaccugaucagcuacggcggcggguggagauuccagggauccuggaacacgggcgaggagguccaagugaucgccguggaaccugggaagaaucccaaaaacguccagaccacaccgggaaccuuuaagaccccugagggcgaagugggggccauugcucucgauuucaagcccggaacaagcggcucuccuaucguuaaucgcgagggcaaaauuguggggcuguacggaaacggcgucgugacgaccuccgggacauauguuagcgccaucgcgcaggcuaaggccucucaagaaggaccccuucccgagauugaggacgaaguguuuaaaaagcggaaucugaccaucauggaucugcacccuggcuccgggaaaacaagacgcuaccucccggccauuguccgggaggcuaucaagagaaagcugcgcacccuuauccuggcccccacgcgggugguugcgagcgaaauggcugaggcccucaaaggcaugccuauuagauaucagacaaccgccgugaaguccgaacauaccggacgcgagaucgucgaccugaugugccacgcuacauucaccaugcggcugcucucucccgugagagugccuaacuacaauaugauuaucauggaugaggcccauuuuacagaccccgcuagcauugccgcgcggggcuauaucuccacccgcgucgggaugggagaagccgcugccaucuucaugacggcuacaccuccgggcagcguugaggccuuuccccagucuaacgccgugauucaggaugaagagagagacaucccugaacgguccuggaauagcggguacgauuggauuaccgacuuccccggaaaaacagugugguuugucccuucuaucaagagcggcaacgauauugcuaauugucuucgcaaaaacgggaagagagugauccaacugucccggaagaccuucgacacggaguaucagaaaaccaagaacaaugacugggauuacguugugacaaccgacaucucugagaugggcgcgaacuucagagccgaucgcgucauugacccccggagaugccugaaaccggugauccucaaggauggaccugaacgcguuauucuggcuggccccaugcccgugacagucgccagcgccgcucagcggagagggcgcaucggacggaaucagaacaaagagggcgaccaauacguguauauggggcagccucuuaauaacgaugaagaccacgcccauuggaccgaggcgaagaugcugcucgauaauauuaacacacccgagggaaucauuccugcucuguuugaaccggagagagaaaaguccgccgccaucgacggcgaguaccgccugagaggggaagcucggaaaaccuucgucgagcucaugcgcagaggcgaucuucccguguggcugucuuauaagguugccagcgagggauuucaguacuccgaccggcgcuggugcuucgauggcgaaagaaauaaccaggugcuggaggaaaauauggacguggagaucuggacgaaagaaggggagcggaagaaacucagaccucgcuggcuggacgcgcggacauauagcgauccccuugcccugagagaguuuaaggaauucgcugccggacgccggucugucuccggcgaccucauucuggagaucgggaaacugccucaacaccucacccuuagagcucagaacgcccuggauaaucugguuaugcuccacaacagcgaacagggaggcaaggcuuaccggcaugccauggaggaacugcccgacaccauugagacacuuaugcugcucgcgcugaucgccgugcugaccggcggggugacacucuuuuuccuuuccggaaagggccuggggaaaacgucuauuggacugcucugugucaccgcuagcuccgcccugcuuuggauggcuucuguggagccgcacuggaucgccgccagcaucauucuggaauuuuuccucaugguucugcugaucccugagcccgauaagcagcgcacaccucaagacaaucagcucgcuuauguggucauuggccuucuguuuaugauccuggcgguggccgcuaacgaaauggggcuccuggagaccacaaaaaaggaucuuggaauuggcuacgucgccaccgagaaccaucagcacgccacgaugcuggacguggaucucagacccgcuuccgccuggacccuguacgcgguugccacaaccgugaucacaccuaugaugcggcacaccaucgaaaauacgacagcuaacauuagccugaccgccaucgcuaaucaagccgcgauucucaugggccuugacaaaggguggcccaucucuaagauggauauuggagucccgcugcuggcccucggcugcuauucccaggugaacccucugacacuuaccgcugccguucugaugcucguggcucauuacgccaucauugggcccggacugcaggcuaaggccacccgcgaggcgcagaaaagaacagccgcuggcaucaugaagaaucccacggucgacgggaucguggccauugaucuggacccugugguuuaugacgcuaaauucgaaaagcaacucggacagaucaugcuucugauucuguguaccagccagauccuccugaugcggacaaccugggcccuuugcgagucuauuacacuggccaccggcccgcucacgacacugugggaaggcucccccgggaaauuuuggaacaccaccaucgcggucagcauggcuaauaucuuccgcggaucuuaccuggccggcgcugggcucgccuucagccuuaugaagucccugggaggcgggagacggggaacaggcgcccagggcgagacccugggggagaaguggaaacgccaacucaaccagcugucuaagagcgaauuuaauauuuauaaaagauccggaaucauggagguggaucggagcgaagcuaaggagggccuuaaaagaggggaaacaacgaagcacgccgugucccgcggaaccgcgaagcugcggugguucgucgagagaaaccucguuaaaccugagggcaaggugauugaccugggguguggacgcggcggcuggucuuacuauugcgccgggcugaaaaaggugacagaagucaaaggauacaccaagggcgggcccggacaugaggaaccuauccccauggcuacauacggcuggaaucucgugaaacuucacagcgggaaggauguuuuuuucaugccuccggagaagugugacacccugcugugcgauauuggagaauccucucccaacccuacgaucgaggagggccggacccucagagugcugaaaauggucgaacccuggcuucgcggcaaucaguuuuguaucaagauucugaacccuuauaugcccagcgugguugagacacucgaacagaugcaacggaaacaugggggaaugcuggugagaaauccgcugucccgcaacucuacccacgagauguacugggucagcugcggcacagggaauaucguguccgccgugaacaugaccagccggaugcuccugaacagauucacaauggcucaccgcaagccuaccuaugagcgggacgucgaucuuggagccggcacgagacauguugcgguggaacccgagguggccaaucuggacauuaucgggcagcgcauugaaaacaucaaaaaugagcacaagucuacauggcauuacgaugaagacaaccccuauaagaccugggcuuaccacggauccuaugaggucaaaccuagcggcucugccuccagcauggugaauggcguugugagacuccugaccaagcccugggaugucauuccuauggugacacagaucgcuaugacggacaccacaccguuugggcaacagcggguuuucaaagagaagguggacacccgcacacccagagccaaacggggaaccacacagaucauggaagucaccgcuaaguggcuuuggggcuuucugucuagaaacaagaaaccucggauuuguacgcgcgaggaauucaccagaaaggugcgguccaaugccgcgaucggggccguuuuuguggaugagaaccaguggaauagcgcuaaagaagccgucgaggacgagcgcuucugggaucucgugcacagagaacgggagcugcauaagcaaggaaaaugcgcuacaugcgucuacaacaugaugggcaagcgcgaaaagaaacugggggaguuuggcaaggccaaaggauccagagccauuugguacauguggcucggcgcgcgguuccuggaauucgaggcucuuggguuuaugaaugaggaccacugguucagccgcgaaaacucucugagcggaguggagggcgaagggcuccauaagcugggauauauccuuagagauauuuccaaaauccccggcgggaauauguacgccgacgauaccgccggcugggacacacggaucaccgaggaugaccugcagaacgaggcuaagauuacggauaucauggaaccugagcacgcccuccuggcuacaucuauuuuuaaacugaccuaucagaauaagguugugcgcguccagagacccgccaagaacggaacagugauggacgugaucagccggcgcgaucaaagaggcuccgggcagguuggaaccuacggccucaacacguucaccaauauggaagugcagcugauucggcagauggagucugaagggaucuuucuuccgagcgagcuggagacaccuaaccucgcggaaagaguccuggacuggcuugagaaacauggagccgaacgccugaagcggauggcuaucuccggcgacgauugugugguuaaacccauugacgauagauucgccgcugcccucaccgcgcugaaugacauggggaaggugcgcaaagauaucccucaaugggagcccucuaagggcuggaacgacuggcagcaggucccuuuuugcagccaccacuuccaucagcugauuaugaaggauggacgggaaaucgugguccccuguagaaaucaagacgagcucgugggccgcgcccggguuucccagggggcuggauggagccugagagagacagccugccuuggcaaaucuuaugcucagauguggcaacugauguacuuucaccgccgggaucucagacuggccgcuaacgccauuuguuccgcggugccggucgacugggugccuaccagccgcacaaccuggucuauccaugcccaccaccaguggaugacgacagaagauaugcuuuccguuuggaaucggguguggaucgaggaaaaccccuggauggaggacaagacccaugucagcuccugggaagaggugcccuaucuggggaaaagagaggaccaguggugcggaucucucauuggccugaccgcucgggccacaugggccaccaauauccagguggcuauuaaccaaguuagacgccugaucgggaaugaaaacuaccucgauuacaugacaagcaugaagcgguucaaaaaugaguccgacccugaaggcgcccugugguga

SEQ ID NO: 18517 - RNA, 9879 nt, Artificial Sequence
  derived and/or modified CDS sequence (opt5) from DENV-1__KJ189302__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggauuucguugagggacuguccggcgccacauggguggacgucgugcucgagcacgggagcugugugacgaccauggcuaagaauaaacccacacuggauaucgaacugcucaagaccgaggucacaaacccugccguucugcgcaaacuuugcauugaagcgaagaucucuaauaccacgacagacuccagauguccgacccaaggagaggccacccugguggaagagcaggaugcuaacuuugugugccggcgcacauucgucgacagaggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucagcaucaaguugggaaugagacaaccgaacacggaacaaucgcuaccauuacgccccaggccccuaccuccgagauccagcugacagacuacggcgcccugacccucgacuguagcccccggacaggccuggauuuuaacgaaauggugcuucugaccaugaaggagaaaucuuggcucguccauaagcagugguuccuggaccuuccucugcccuggacguccggggcuagcacaucccaagagaccuggaaucgccaggaucuccuggugacauuuaaaaccgcgcacgccaagaagcaggaagucgugguucugggaucucaagagggcgcuaugcacaccgcccucacaggggccacggaaauucagaccagcggaacaaccacaaucuucgcuggccaucugaaaugcagacuuaagauggacaaacugacccucaaggggauguccuaugugauguguacgggcagcuucaaacuggagaaggaagucgccgagacacagcacggaaccgugcugguucaggugaaguacgagggcaccgaugcgccgugcaaaauuccuuuuucuacacaagacgaaaagggggucacccagaacggacggcuuaucacagcuaaucccaucgugacggauaaagagaagccugugaacauugaaaccgagccccccuucggcgaguccuauaucguugucggggccggagaaaaagcccucaagcugagcugguuuaagaaaggcucuagcauugggaagauguucgaggcuacagccagaggcgcucgccggauggccauccugggagacaccgcgugggauuuuggcuccauugggggaguguucacaucugugggcaaacucguccaucagguguuugggaccgccuacggaguucuguucagcggcguguccuggacgaugaagaucgggaucggcauucuucugaccuggcucggacugaauagcagaucuacaucccugagcaugaccuguaucgcugucggcauggugacacuuuaccucgggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcuguccgccgcgauuggcaaggccugggaggagggggugugcggcaucagaucugcuacgcgccucgaaaauauuauguggaaacagaucagcaacgagcugaaucauauccuucuggaaaacgacaugaaguuuacagucguggugggagacgccaauggcauucucgcucaggggaaaaagaugauccggccgcaacccauggagcacaaauacuccuggaagucuuggggaaaggccaaaauuaucggcgccgauauucagaacaccaccuucaucaucgacgggccugauacacccgaauguccugacggacagagagcuuggaauauuugggaggucgaggauuauggcuuuggcaucuucaccacgaacauuuggcugaagcugcgcgacagcuacacacagaugugcgaucaccggcuuauguccgcggccaucaaagacagcaaggcuguucaugccgauaugggguauuggauugaaucugagaaaaaugaaaccuggaagcucgccagagcuuccuucaucgaggugaagacauguaccuggcccaaaagccacacacuguggucuaacggagugcuggaauccgagaugaucauuccgaagaucuacggcgggccuauuagccaacauaauuaucgccccggauacuuuacccagacggccggcccuuggcaccucgggaaacuggagcuugacuucgaucugugcgaaggaaccacagucgugguugacgagcacugcggcaaccggggccccucucucagaaccacaaccgugacggggaagaucauucaugaaugguguugccggagcuguacacugccuccccugcgcuuuagaggagaggauggcugcugguacgggauggagauccggccggucaaagaaaaggaggaaaaucuugugagauccaugguuagcgcgggaucuggcgagguggacuccuucagccucgggauccugugugucuccauuaugaucgaagaggugaugcgcucucgguggagcagaaagaugcugaugaccggaacacucgcuguuuuucugcuucugauuaugggccagcucaccuggaacgaccugauccgccugugcauuauggugggcgccaaugccuccgauagaauggggaugggaaccacauaucuugcucugauggccacguucaaaaugcggccuauguuugcggucggccuccuguuccgcagacucaccucucgggaggugcugcuucugacaaucgggcucagccugguggcuuccgucgaacugcccaacucucuugaggaacugggagacggccucgccauggggauuaugaugcugaagcuccugaccgaguuucaaccccaccagcuuuggacaacccugcucagccugacguucguuaaaacaacccugucccuugauuacgccuggaagaccacagcuauggugcugagcaucgugucucucuuuccucugugucucuccaccacaagccagaaaacgaccuggcugccgguccuucugggaucuuucggcugcaagccccugacaauguuucucaucaccgaaaacaagauuuggggccgcaaauccuggccucugaaugaggggaucauggccauuggaaucgugagcauucuucugucuucccuccugaagaacgacguuccccucgcuggcccucugaucgccgggggaaugcuuaucgcguguuaugugauuagcggcuccagcgccgaucugucucuggagaaagcugccgaagucagcugggagcaggaagcugagcauuccggggccucucacaauauccucguggaaguucaagacgauggaacaaugaagauuaaagacgaggagagagaugacacccugacgauccuucugaaggccacccuccuggcugugagcggcgucuaccccauguccauuccugcgacacucuucgugugguauuucuggcagaaaaagaagcagcggucuggcguccugugggauacccccagcccgccugaaguggagcgcgccguucuugacgaugggaucuacagaauccugcagcggggacugcucggccgcucccaagugggggucggaguguuucaggacggcguuuuccauacaauguggcacgugaccagaggggcuguccugauguaucagggaaaacggcuugaacccucuugggccagcgugaagaaagaccugauuuccuacggcggcggguggagauuucagggaagcuggaacacaggcgaggaggugcaaguuaucgccgucgaaccugggaagaaucccaaaaacgugcagacgaccccgggaacauucaagaccccugagggcgaagugggggcuauugcccucgauuuuaagcccggaaccucuggcuccccuaucgucaaucgcgagggcaaaauuguggggcuguacggaaacggcguugugacaacgagcgggaccuaugucucugcgaucgcucaggccaaggccucccaagaaggaccccuccccgagauugaggacgaaguguucaaaaagcggaaucugacaaucauggaucuucacccuggcagcgggaaaaccagacgcuaccugccggcuaucguucgggaggccauuaagagaaagcugcgcacacucauccuggcgcccacccggguggucgcuuccgaaauggccgaggcccuuaaaggcaugccuauuagauaucagacgacagcugugaagucugaacauaccggacgcgagaucguugaccugaugugccacgccaccuuuacaaugcggcuccugagccccgugagagucccuaacuacaauaugauuaucauggaugaggcucauuucaccgaccccgccuccaucgcggcccggggcuauauuagcacacgcguggggaugggagaagcugccgcuaucuuuaugaccgccacgccuccgggcucuguggaggccuucccccaguccaacgcugucauucaggaugaagagagagacaucccugaacggagcuggaauucuggguacgauuggauuacagacuuucccggaaaaaccguuugguucgugccuagcaucaaguccggcaacgauaucgcgaauugucugcgcaaaaacgggaagagagugauucaacucucucggaagacauucgacaccgaguaucagaaaacgaagaacaaugacugggauuacgucgugaccacagacaucagcgagaugggcgccaacuuuagagcugaucgcguuauugacccccggagaugccuuaaaccggugauccugaaggauggaccugaacgcgucauucuggccggccccaugcccgugaccguugccuccgcugcccagcggagagggcgcaucggacggaaucagaacaaagagggcgaccaauacguguauauggggcagccucucaauaacgaugaagaccacgcgcauuggacagaggcuaagaugcugcuugauaauauuaacacccccgagggaaucaucccugcccuguucgaaccggagagagaaaagucugccgcuauugacggcgaguaccgccucagaggggaagcccggaaaacauuugucgagcugaugcgcagaggcgaucugcccguguggcucagcuauaaggucgcguccgagggauuccaguacagcgaccggcgcuggugcuuugauggcgaaagaaauaaccaggugcuugaggaaaauauggacguugagaucuggaccaaagaaggggagcggaagaaacugagaccucgcuggcuggacgcccggacguauucugauccccucgcucugagagaguucaaggaauuugccgcuggacgccgguccgugagcggcgaccuuauucuggagaucgggaaacucccucaacaccugacacugagagcccagaacgcucucgauaaucuugugaugcugcacaacuccgaacagggaggcaaggccuaccggcaugcgauggaggaacugcccgacaccauugagacccucaugcugcuugcccugaucgcuguccucacaggcgggguuacccuguucuuucugucuggaaagggccucgggaaaacaagcaucggacuucugugugugacggccuccucugcucugcucuggauggccagcguggagccgcacuggauugccgcuuccaucauucuggaauucuuucuuaugguccugcucaucccugagcccgaucgccagagaaccccucaagacaaucagcuggcguaugugguuauuggccugcucuucaugauccuuacaguggccgcuaacgaaauggggcugcuggagaccacaaagaaagaucucggaaucggcuacgucgccgccgagaaccaucagcacgcuaccaugcuggacguggaucuucggcccgccagcgcguggacgcuguacgccgucgcuaccacagugauuaccccuaugaugcgccacacaaucgaaaauaccacggccaacauuucucucacagcuaucgccaaucaagcggccauucugaugggccuggacaagggguggcccaucuccaaaauggauauuggaguuccgcuccuugcucugggcugcuauagccaggugaacccucugacccucacagccgcuguccugaugcuuguggcccauuacgcuaucaucgggcccggacugcaggccaaggcgaccagagaggcccagaagcggaccgcugccggcauuaugaaaaaucccacaguugacgggaucguggcuauugaucucgacccugucguguaugacgccaaguuugaaaaacaacugggacagaucaugcugcucauucuuuguacgucucagauccugcugaugcgcaccacaugggcccucugcgaguccaucacccuggcgacaggcccgcuuaccacgcugugggaaggcagccccgggaaguucuggaacacaaccauugcugugucuauggccaauaucuucagaggaagcuaccucgcuggcgccgggcuggccuuuucccugaugaaaucucucggaggcgggcggcgcggaaccggcgcucagggcgagacacuuggggagaaguggaagagacaacugaaccagcugagcaaauccgaauucaauaccuauaagcggagcggaauuauggagguugauagauccgaagccaaagagggccucaagcgcggggaaacaacgaaacacgcggucucucggggaaccgccaagcugagaugguuuguggagcgcaaccuugugaagccugagggcaaagucaucgaccugggguguggacggggcggcuggagcuacuauugcgcugggcucaagaaaguuacagaagugaagggauacaccaaaggcgggcccggacaugaggaaccuauucccauggccacauacggcuggaaucuggugaagcugcacuccgggaaagaugucuucuuuaugccuccggagaagugugacacccuccuuugcgauaucggagaaucuagccccuccccuacgaucgaggagggcagaacccugcgcgugcugaagaugguugaacccuggcuccggggcaaccaguucuguauuaaaauccugaauccuuauaugcccucuguggucgagacacuugaacagaugcaaagaaagcaugggggaaugcuggugcgcaacccgcucagccggaauuccacccacgagauguacuggguuagcugcggcacagggaacauugugucugcugucaauaugaccuccagaaugcugcugaaccgcuuuacaauggcccaccggaaaccuaccuaugagagagacguggaucucggagcgggcacgcgccauguggccgucgaacccgagguugcuaaccuggacaucauugggcagagaaucgaaaauauuaagaacgagcacaaaagcacauggcauuacgaugaagacaaucccuauaagaccugggccuaccacggaucuuaugaggugaagccuuccggcagcgcuucuuccauggugaacggcgucgugcggcuucugaccaaacccugggauguuaucccuauggugacacagaucgccaugacggacaccacaccguucgggcaacagcgcgucuuuaaggagaaaguggacaccagaacaccccgggcuaagagaggaaccacacagauuauggaaguuaccgccaaauggcucuggggcuuccugagccggaauaagaagccucgcaucuguacgagagaggaauuuacccggaaagugcgcuccaacgcggccauuggggcugucuucguggaugagaaucaguggaacagcgccaaggaagcuguugaggacgagagauuuugggaucuugugcaccgggaacgcgagcugcauaaacaaggaaagugcgccacaugcgucuacaauaugaugggcaaaagagaaaagaagcucggggaguucggcaaagccaagggaucucgggcgaucugguacauguggcugggcgcucgcuuccuggaauuugaggcccucggguucaugaacgaggaccacugguuuagcagagaaaauucccugucuggaguggagggcgaagggcuucauaaacugggauauauucuccgggauaucagcaagauccccggcgggaacauguacgccgacgauaccgcuggcugggacacacgcauuaccgaggaugaccugcagaaugaggccaaaaucacggauauuauggaaccugagcacgcucuucuggccacauccaucuucaagcucaccuaucagaacaaagucgugagaguucagcggcccgcgaagaauggaacagugauggacgucauuucucgcagagaucaacggggcagcgggcaggugggaaccuacggccugaacacguuuaccaacauggaagugcagcugaucagacagauggaguccgaagggaucuuccucccgucugagcuggagacaccuaaucuugccgaacgcguucuggacuggcucgagaagcauggagcugaacggcugaaaagaauggccauuagcggcgacgauuguguggucaagcccaucgacgaucgcuuugcuaccgcccuuacagcgcugaacgacauggggaaagugcggaaggauauuccucaaugggagcccuccaaaggcuggaaugacuggcagcagguuccuuucugcagccaccacuuucaucagcucaucaugaaggauggaagagaaauugugguccccugucgcaaccaagacgagcuggugggccgggccagagucucucagggggcuggauggucccugcgcgagaccgccugccucggcaagagcuaugcucagauguggcaacugauguacuuccaccggagagaucuucgccuggccgcuaaugccaucuguucugcggugccgguugacugggugccuacaucccggaccacguggagcauccaugcccaccaccaguggaugacaaccgaagauaugcucuccgucuggaacagaguguggauugaggaaaaucccuggauggaggacaaaacccauguuucuagcugggaagaggugcccuaucuggggaagcgggaggaccaguggugcggaucccuuaucggccugacagcuagagccaccugggccacaaacauucaggucgcuaucaaucaagugcgccggcucauugggaacgaaaauuaccuggauuacaugacgagcaugaaaagauuuaagaacgagucugacccugaaggcgcccugugguga

SEQ ID NO: 18518 - RNA, 9879 nt, Artificial Sequence
  derived and/or modified CDS sequence (opt5) from DENV-1__KJ189303__SS-prME
agcgugaccaugcugcucaugcugcuucccacagcccuggcuuuccaccucacgaccagaggcggggaaccucauaugaucgucuccaagcaggaacggggaaagucucugcuuuuuaagacaagcgccggcguuaauaugugcacccugauugcgauggaccucggggaacugugugaagauacaaugaccuacaagugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugucauugggacaucuaucacccagaagggaaucauuuucauccugcuuaugcuggugaccccuagcauggccaugagaugcguuggcauugggaaucgggauuuuguggagggacucuccggcgcuacaugggucgacguggugcuggagcacgggagcugugucacgaccauggccaagaauaaacccacacuggauaucgaacuccugaagaccgagguuacaaacccugcugugcuucgcaaacugugcauugaagccaagaucucuaauaccacgacagacuccagauguccgacccaaggagaggcgacccucguggaagaacaggaugccaacuucgucugccggcgcacauuuguggacagaggcuggggcaauggguguggacuguucggcaaagggagccuucugaccugcgcuaaguuuaagugcguuacaaaacucgagggaaagauugugcaguacgaaaaccugaaauauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagcccccggacaggccuugauuucaacgaaaugguccugcucaccaugaaggagaaaucuuggcuggugcauaagcagugguuucuugaccugccucuccccuggacguccggggccagcacaucccaagagaccuggaaucgccaggaucugcuggucacauucaaaaccgcucacgcgaagaagcaggaagugguugugcucggaucucaagagggcgccaugcacaccgcucugacaggggccacggaaauucagaccagcggaacaaccacaaucuuugccggccaucuuaaaugcagacugaagauggacaaacucacccugaaggggauguccuaugucauguguacgggcagcuucaaacuggagaaggaaguggcugagacacagcacggaaccguucuugugcaggucaaguacgagggcaccgaugccccgugcaaaauuccuuucucuacacaagacgaaaagggggugacccagaacggacggcucaucacagcgaaucccaucgugacggauaaagagaagccuguuaacauugaaaccgagccgcccuuuggcgaguccuauaucgucgugggggcuggagaaaaagcccugaagcugagcugguucaagaaaggcucuagcauugggaagauguuugaggccacagcuagaggcgcccgccggauggcuauccucggagacaccgccugggauuucggcuccauugggggaguguuuacaucugucggcaaacuggugcaucagguuuucgggaccgcguacggagugcuuuuuagcggcgucuccuggacgaugaagaucgggaucggcauucugcucaccuggcugggacugaauagcagaucuacaucccuuagcaugaccuguaucgccgugggcaugguuacacucuaccugggggugaugguccaggcugacucuggaugcgugauuaacuggaaaggccgcgaacugaaguguggguccggaaucuucguuaccaacgaggugcacacauggaccgaacaauauaaguuucaggccgauagcccuaaacggcucuccgcugccauuggcaaggcgugggaggagggggucugcggcaucagaucugccacgcgccuggaaaauauuauguggaaacagaucagcaacgagcuuaaucauauccugcucgaaaacgacaugaaguucacagugguggucggagacgcuaauggcauucuggcccaggggaaaaagaugauccggccgcaacccauggagcacaaauacuccuggaagucuuggggaaaggcuaaaauuaucggcgccgauacccagaacaccacauuuauuaucgacgggccugauacccccgaauguccugacggacagagagccuggaauaucugggagguugaggauuauggcuucggcauuuuuacgacaaacaucuggcugaaacuucgcgacagcuacacccagaugugcgaucaccggcucauguccgcugcgauuaaagacagcaaggccgugcaugcugauaugggguauuggaucgaaucugagaaaaaugaaacauggaagcuggccagagccuccuucauugaggugaagaccuguacauggcccaaaagccacacccuguggucuaacggaguccucgaauccgagaugaucaucccgaagauuuacggcgggccuaucagccaacauaauuaucgccccggauacuucacgcagaccgcuggcccuuggcaccuggggaaacuugagcuggacuuugaucucugcgaaggaacaaccgugguuguggacgagcacugcggcaaccggggccccucucugagaacaaccacggucacagggaagauuauccaugaaugguguugccggagcuguacccugccuccccuucgcuucagaggagaggauggcugcugguacgggauggagauucggccggugaaagaaaaggaggaaaaucucguuagauccauggugagcgccggaucuggcgaggucgacuccuuuagccuggggauccuguguguguccaucaugauugaagagguuaugcgcucucgguggagcagaaagaugcucaugacaggaacccuggcgguguuccuucugcucaucaugggccagcugaccuggaacgaccugacacgccuuugcauuauggucggcgcuaaugccuccgauagaauggggaugggaacgaccuaucuggcccucauggcuacauuuaaaaugcggccuauguucgccgugggccugcucuuucgcagacugaccucucgggaggugcuucugcucacaaucgggcugagccuggucgcguccguugaacuucccaacucucuggaggaacucggagacggccuggcuauggggauuaugaugcucaagcugcuuaccgaguuccaaccccaccagcuguggacgacacuccugagccugaccuuugugaaaaccacacuuucccuggauuacgccuggaagaccacagccauggugcucagcaucgucucucuguucccucucugucuguccacgaccagccagaaaacaaccuggcuuccggugcugcugggaucuuuuggcugcaagccccucacaauguuccugauuaccgaaaacaagaucuggggccgcaaauccuggccucuuaaugaggggaucauggcuauuggaaucguuagcauucugcucucuucccugcucaagaacgacgugccccuggccggcccucuuaucgcugggggaaugcugauugccuguuaugucaucagcggcuccagcgcggaucugucucucgagaaagccgcugaagugagcugggagcaggaagccgagcauuccggggcuucucacaauauccugguugaagugcaagacgauggaacgaugaagauuaaagacgaggagagagaugacacccuuacaauccugcucaaggccacccugcucgccgucagcggcguguaccccauguccauuccugcuacacuguuugucugguauuucuggcagaaaaagaagcagcggucuggcgugcuuugggauacccccagcccgccugaaguugagcgcgcggugcuggacgaugggaucuaccgcauucugcagcggggacuccugggccgcucccaagucggggugggaguuuuccaggacggcguguuucauacaauguggcacgucacgagaggggccgugcuuauguaucagggaaaacggcuggaacccucuugggcuagcgugaagaaagaccucaucuccuacggcggcggguggagauuccagggaagcuggaacaccggcgaggagguucaagucaucgccguggaaccugggaagaaucccaaaaacgugcagacaaccccgggaaccuuuaagacaccugagggcgaagucggggccauugcucuggauuucaagcccggaacgucuggcuccccuaucgugaaucgcgagggcaaaauuguugggcucuacggaaacggcguggucaccacaagcgggaccuaugugucugccaucgcgcaggcuaaggccucccaagaaggaccccugcccgagauugaggacgaaguuuuuaaaaagcggaaucuuacaaucauggaucugcacccuggcagcgggaaaaccagacgcuaccugccggccauugugcgggaggcuaucaagagaaagcuccgcacgcugauccuugcccccacacgggucguggcguccgaaauggcugaggcccugaaaggcaugccuauuagauaucagaccaccgccguuaagucugaacauacaggacgcgagaucguggaccucaugugccacgcuaccuucacaaugcggcugcugagccccgucagagugccuaacuacaauaugauuaucauggaugaggcccauuuuaccgaccccgcuuccauugccgcgcggggcuauaucagcacgcgcguggggaugggagaagccgcugccaucuucaugacagcuaccccuccgggcucugucgaggccuuuccccaguccaacgccguuauucaggaugaagagagagacaucccugaacggagcuggaacucuggguacgauuggauuacagacuuccccggaaaaaccgugugguuugugccuagcaucaaguccggcaacgauauugcuaauugucuccgcaaaaacgggaagagagucauccaacuuucucggaagacguucgacaccgaguaucagaaaacaaagaacaaugacugggauuacgugguuaccacagacaucagcgagaugggcgcgaacuucagagccgaucgcgugauugacccccggagaugccugaaaccggucauccugaaggauggaccugaacgcgugauucucgcuggccccaugcccguuaccguggccuccgccgcucagcggagagggcgcaucggacggaaucagaacaaagagggcgaccaauacgucuauauggggcagccucugaauaacgaugaagaccacgcccauuggacagaggcgaagaugcuucuggauaauauuaacacccccgagggaaucauuccugcucucuuugaaccggagagagaaaagucugccgccguggacggcgaguaccgccugagaggggaagcucggaaaacguucgucgagcugaugcgcagaggcgaucuccccguguggcuuagcuauaagguugccuccgagggauuucaguacagcgaccggcgcuggugcuucgauggcgaaagaaauaaccaggugcuggaggaaaauauggacguggagaucuggacaaaagaaggggagcggaagaaacugagaccucgcuggcucgacgcgcggaccuauucugauccccuggcccuuagagaguuuaaggaguucgcugccggacgccgguccgucagcggcgaccugauccucgagauugggaaacugccucaacaccugacccucagagcucagaacgcccuugauaaucugguuaugcugcacaacuccgaacagggaggcaaggcuuaccggcaugccauggaggaacuccccgacacaaucgagacccugaugcuucuggcgcucauugccgugcugacaggcggggugacgcuguuuuuccucucuggaaagggccuugggaaaaccagcaucggacugcugugugucacagcuuccucugcccuccuguggauggcuagcguggagccgcacuggauugccgccuccaucauccuugaauuuuuccugaugguucuccugauuccugagcccgaucgccagagaaccccucaagacaaucagcuggcuuauguggucaucggccuccuuuuuaugauucugacaguggcggccaacgaaauggggcugcucgagaccacgaagaaagaucugggaaucggcuacgucgcugccgagaaccaucagcacgccaccaugcuugacguggaucugcggcccgcuagcgccuggacacucuacgcgguugccaccacagugauuaccccuaugaugcgccacacgaucgaaaauacaaccgcuaacaucucucugacagccauugcuaaucaagccgcgauccugaugggccucgacaagggguggcccauuuccaaaauggauaucggagucccgcuucuggcccugggcugcuauagccaggugaacccucucacccugaccgcugccguucuuaugcugguggcucauuacgccauuaucgggcccggacuccaggcuaaggccacaagagaggcgcagaagcggacggccgcuggcauuaugaaaaaucccaccgucgacgggaucguggccaucgaucuggacccugugguuuaugacgcuaaguucgaaaaacaacugggacagauuaugcuccuuauccuguguacaucucagauucugcucaugcgcaccacaugggcccugugcgaguccaucacccuugccacgggcccgcugacaacccucugggaaggcagccccgggaaguuuuggaacaccacaauugcggucucuauggcuaauaucuucagaggaagcuaccuggccggcgcugggcuggccuucucccucaugaaaucucuuggaggcgggcggcgcggaaccggcgcccagggcgagacacugggggagaaguggaagagacaacugaaccagcucagcaaauccgaauuuaauacguauaagcggagcggaaucauggagguggauagauccgaagcuaaagagggccugaagcgcggggaaaccacaaaacacgccgugucucggggaaccgcgaaacuuagaugguucgucgagcgcaaccugguuaagccugagggcaaagugauugaccucggguguggacggggcggcuggagcuacuauugcgccgggcugaagaaagugacagaagucaagggauacaccaaaggcgggcccggacaugaggaaccuauccccauggcuacguacggcuggaaucuggugaagcuccacuccgggaaagauguguuuuucaugccuccggagaagugugacacccuucugugcgauauuggagaaucuagccccaacccuacaaucgaggagggcagaacccugcgcguucucaagauggucgaacccuggcugcggggcaaucaguuuuguauuaaaauccuuaacccuuauaugcccuccgugguugagacacuggaacagaugcaaagaaagcaugggggaaugcucgugcgcaauccgcugucucggaacagcacccacgagauguacugggucuccugcggcacagggaauaucgugagcgccgugaacaugaccucuagaaugcugcucaaccgcuucacgauggcucaccggaaaccuacauaugagagagacgucgaucugggagccggcacccgccauguugcgguggaacccgagguggccaaucuugacauuaucgggcagagaauugaaaacaucaagaaugagcacaaauccaccuggcauuacgaugaagacaaccccuauaagacaugggcuuaccacggaagcuaugaggucaagccuucuggcuccgccagcucuauggugaauggcguugugcggcugcucacgaaacccugggaugucauuccuauggugacccagaucgcuaugacagacaccacaccguuugggcaacagcgcguuuucaaggagaaaguggacaccagaacaccccgggccaagagaggaaccacgcagauuauggaagucaccgcuaaauggcuguggggcuuucuuucccggaacaagaagccucgcaucuguacaagagaggaguucacccggaaagugcgcagcaaugccgcgaucggggccguuuuuguggaugagaaccaguggaacuccgcuaaggaagccgucgaggacgagagauucugggaucuggugcaccgggaacgcgagcuccauaaacaaggaaagugcgcuacaugcgucuacaacaugaugggcaaaagagaaaagaagcugggggaguuuggcaaagccaagggaagccgggccauuugguacauguggcugggcgcgcgcuuccucgaguucgaggcucugggguuuaugaaugaggaccacugguucucuagagaaaacagccuuuccggaguggagggcgaagggcugcauaaacucggauauauccugcgggauauuucuaagauccccggcgggaauauguacgccgacgauaccgccggcugggacacgcgcauuacagaggaugaccuucagaacgaggcuaaaaucaccgauaucauggaaccugagcacgcccugcucgcuacaagcauuuuuaagcugaccuaucagaauaaaguugugagaguccagcggcccgccaagaacggaacggugauggacgugaucucccgcagagaucaacggggcucugggcagguuggaaccuacggccugaacacauucaccaauauggaagugcagcucauuagacagauggagagcgaagggaucuuucugccguccgagcuugagacaccuaaccuggcggaacgcguccucgacuggcuggagaagcauggagccgaacggcuuaaaagaauggcuauuucuggcgacgauugugugguuaagcccaucgacgaucgcuucgccaccgcucugacagcccucaaugacauggggaaagugcggaaggauaucccucaaugggagcccagcaaaggcuggaacgacuggcagcaggucccuuuuugcucccaccacuuccaucagcugauuaugaaggauggaagagaaaucgugguccccugucgcaaucaagacgagcuggugggccgggcgagaguuagccagggggccggauggucucuccgcgagaccgcuugccugggcaaguccuaugcccagauguggcaacuuauguacuuucaccggagagaucugcgccucgcugccaacgcuauuuguagcgccgugccggucgaaugggugccuacgucucggacaaccugguccauccaugcgcaccaccaguggaugaccacagaggacaugcugagcguuuggaauagaguguggauugaagagaaccccuggauggaagauaaaacccaugucuccucuugggaggaggugcccuaucuugggaagcgggaagaccaguggugcggaagccugaucggccucacagccagagcuacgugggccaccaauauccagguggccauuaaccaaguucgccggcugaucgggaaugagaacuaccuggacuacaugacauccaugaaaagauucaagaaugaaagcgauccugagggcgcucucugguga

SEQ ID NO: 18519 - RNA, 9879 nt, Artificial Sequence
  derived and/or modified CDS sequence (opt5) from DENV-1__KR028435__SS-prME
agcgugaccaugcugcucaugcugaugcccacagcccuugcuuuccaccugacgaccagaggaggggaaccucauaugaucguguccaagcaggaacgggggaaaucucuccuguuuaagaccagcgccggcguuaacaugugcacccuuauugcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauuuguacaggcucuuucaaacucgagaaggaagucgccgagacccagcacggaaccgugcugguucagaucaaguacgagggcacagacgcgccgugcaaaaucccuuucuccacccaagaugaaaagggggugacacagaacggacggcugauuacggcuaaucccaucgucaccgacaaagagaagccugugaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcaucagaagcgccacgcgccucgaaaacauuauguggaaacagaucuccaacgagcugaaucauauucuucuggaaaacgacaugaaguucacaguuguggucggagauguggcuggcauccucgcccaggggaaaaagaugauucggccgcaacccauggagcacaaauacucuuggaaaagcuggggaaaggccaagaucaucggcgcugacgugcagaauaccaccuuuauuaucgaugggccuaacacacccgaauguccugacgaucagagagcguggaauauuugggaggucgaggacuauggauucggcaucuuuaccacgaacauuuggcugaagcugcgcgauuccuacacacagguuugcgaccaccggcuuaugagcgccgcuaucaaagauucuaaggccgugcaugccgacaugggcuauuggaucgaauccgagaaaaaugaaaccuggaagcucgcuagagccagcuucauugaggugaagacauguaucuggcccaaaucucacacccugugguccaacgggguccuggaaagcgagaugauuaucccgaagauuuacggaggcccuaucucucaacauaauuaucgccccggguacuucacacagaccgcgggaccuuggcaccucggcaaacuggagcuugauuuugaccugugcgaagggacgaccgugguuguggaugagcacugcggaaaccggggccccagccucagaacaaccacagucaccggcaagaucauucaugaaugguguugccgguccuguacgcugccuccccugcgcuucagaggggaggacggaugcugguacggcauggagauccggccggugaaagaaaaggaggaaaaucuuguuaagagcauggugucugcuggguccggagaggucgacagcuuuucccucggccugcuguguauuucuaucaugauugaagaggugaugagaagccgcuggucccggaaaaugcucaugacagggacccuggccguuuucuuucuucugaucaugggacagcucacauggaacgaucugauuagacugugcaucauggugggcgccaaugcuucugaccgcaugggcauggggaccaccuaucuugcccugauggcgacauucaagaugagaccuauguuugcugucggacuccuguuccggcgccucacgagcagagaggugcugcuucugaccaucggccucucccugguggccucugucgaacugcccaacagccuugaggaacugggggauggacucgccaugggcauuaugauccugaaacuccugacagacuuucaaucccaccagcuuugggcuacccugcucagccugacauucauuaagaccacguuuucucugcauuacgccuggaaaacaauggcuaugguucuuuccaucgugagccuguucccccucugucugucuaccaccucccagaagacaaccuggcucccugugcugcuugggagccugggaugcaagccgcugacaauguuucucauugccgagaauaaaaucuggggccggaagucuuggccccugaacgaaggcaucauggcggucgggauuguguccauccuucugagcucccuccugaaaaacgauguuccucucgccggaccccugauugcuggcgggaugcuuaucgccuguuaugugauuagcggaucuagcgcugaccugucccuggagaaggccgccgaggucucuugggaagaggaagcugagcacagcggcgcgucccauaauauccucguggaaguucaggaugacgggacgaugaaaaucaaggaugaggagcgcgacgauacccugacaauucuucugaaagccacccuccuggcuaucucuggaguguacccucucagcauucccgccacacuguucgucugguauuucuggcaaaagaagaaacagagauccggcgugcuuugggacaccccuucucccccggaagucgagcgggccgugcuggaugacggcaucuaccgcauuaugcagagagggcugcucggacggagccagguuggcgugggggucuuucaagaaaacguguuccacacgauguggcacguuacccgcggagcugugcugauguaucagggcaagagacuugagccuuccugggccagcgucaaaaaggaccugaucucuuacgggggaggcuggcggcuccagggcuccuggaauacaggggaggaaguccaggugauugcgguugagcccggcaaaaauccuaagaauguccaaaccgcucccggcacauuuaagaccccggaaggggaggugggagccaucgcccuggauuucaaaccuggcacaagcgggucucccaucgugaacagagaaggaaagauugucggccucuacggcaauggggugguuacgaccuccggaacauaugugagcgcuaucgcccaggcgaaggcuucccaggagggcccucugcccgagauugaagacgaggucuuucgcaagcggaaccuuaccaucauggaucugcaucccgggucuggaaaaaccagacgcuaccugccugccauugugcgggaagccaucaagagaaagcuccgcacacugauccuugcuccgacgcggguuguggccagcgagauggcugaagcccugaaaggcaugcccauuagauaucaaaccacagcggucaaguccgagcacaccgggaaagagaucguggaccucaugugccaugccacauucaccaugcgccugcugagcccuguucgggugcccaauuacaacaugauuaucauggaugaagcucacuuuacggacccuucuuccauugccgcuagaggcuauaucagcacacgggucggaaugggcgaggccgccgcuaucuucaugaccgcgacacccccugggucuguggaagccuuuccgcagagcaaugcugugauucaggaugaggaaggaggcaucuccgagcgcucuuggaacagcggguacgaguggauuacagacuuccccggaaagaccgucugguuuguuccuuccaucaaaucuggcaaugauauugccaacugucucagaaagaaugggaagcgggugauccagcuuagccgcaaaacauucgacaccgaauaucaaaagacgaaaaacaacgauugggacuacguggucacaaccgacauuuccgagaugggcgccaauuucagagcugaucgggugaucgaccccagacgcugccugaagccuguuauccugaaagauggacccgaacgggugauucucgccggcccgaugccugucacaguggcgagcgcugcccagagacgcgggcggaucggaagaaaccauaauaaggagggcgaccaguacauuuauauggggcagccccugaacaaugaugaggaccacgcccacuggaccgaagcuaagaugcuucuggauaacaucaauacgcccgagggaauuaucccugcccucuuugaacccgagcgcgaaaaaucugcggccaucgacggcgaguaccggcugagaggggaggcucgcaagaccuucguugaacugaugagacggggcgaucucccuguguggcuuuccuauaaagucgccagcgagggauuucaauacuccgaccgcagauggugcuucgauggcgaacggaacaaucaggugcuggaggaaaacauggacgucgagauuuggacaaaggagggggaacgcaaaaagcugagaccgcgguggcucgaugcuagaaccuauucugacccccuggcccuucgcgaguuuaaagaguucgcugccggacggagaagcguguccggcgaccugauccucgagauugggaagcugccucagcaucugacacagcgcgcgcaaaaugcccucgauaaccuuguuaugcugcacaauucugaacagggaggccgggcuuacagacaugccauggaggagcugcccgacaccaucgaaacacucaugcugcuugcucugauugccgugcucaccggcggggugacgcuguuuuuccugagcggacggggccucgggaagacauccaucggacuucugugugucauggccagcucuguucugcucuggauggcuuccguggagccucacuggaucgcggccagcauuauccuggaauuuuuccuuauggugcugcucauucccgagccggaucgccagagaaccccucaggacaaccaacuggcuuaugucgugaucggccugcucuuuaugauucuuaccguugccgccaaugagauggggcugcuggaaacaaccaaaaaggaucucggaaucggccacguggcugucgagaaccaucaccaugccacaaugcuggacguggaucuucaccccgcgucugccuggacgcuguacgcugucgccaccacaauuaucaccccuaugaugcggcauacaaucgaaaacaccacggcuaauauuucccucaccgccaucgcgaaccaggccgcuauucugaugggccuggacaaaggguggcccaucagcaagauggauauuggagugccucuccuugcccugggcugcuacucucagguuaauccccugacacucaccgcugccgugcugaugcuugucgcucacuaugccaucaucgggccgggacugcaagcgaaagccacacgcgaggcucagaagagaaccgccgcuggcauuaugaagaacccuacgguggacgggaucguugccauugaucucgaccccguggucuacgaugccaaauucgaaaagcagcugggacagaucaugcugcucauucuuuguacaagccaaauccugcugaugcggaccacaugggcgcucugcgaguccaucacccuggcuaccggcccccuuacaacgcugugggagggcucuccugggaaauuuuggaauaccacaauugccgugagcauggcuaacaucuuccgcggauccuaucucgccggcgccgggcuggcuuucagccugaugaagucccucggaggcgggagacggggaaccggcgcccagggcgaaacacuuggggagaaauggaagcgccagcugaaucagcugucuaagagcgaauuuaacaccuacaaaagauccggaauuauggagguggaccggucugaagcgaaggagggccucaaaagaggggagacgacaaagcacgccguuagccgcggaaccgcuaaacugcggugguucgucgaaagaaaucuugugaagccggagggcaaggugaucgaccugggguguggacgcggcggcugguccuauuacugcgccgggcucaaaaaggucaccgaaguuaaaggauauacaaagggcgggcccggacaugaggaaccuauucccauggcuaccuacggcuggaaccuggugaaacuguacucugggaaggauguguuuuucaucccucccgagaaaugugacacacuccuuugcgauauuggagagagcuccccuaauccgacgaucgaagagggccggacccugagaguccugaagaugguggaacccuggcuccgcggcaaccaauuuuguaucaagauucugaauccuuauaugcccagcguuguggagacacuugagcagaugcagcggaaacacgggggaaugcuggucagaaacccucucucucgcaauuccacccaugaaauguacugggugagcugcggcacagggaacaucguuucugccgugaauaugaccucccggaugcugcugaacagauucacgauggcgcaccgcaagcccaccuaugagcgggacgucgaucucggagccggcacaagacacguggcuguggaaccggaggucgccaaccuggacauuaucgggcagcgcauugaaaauaucaaacaugagcacaagagcaccuggcauuacgaugaggacaacccuuauaaaacaugggcuuaccacggaucuuaugaaguuaagcccuccggcagcgccuccagcauggugaauggcguggucaaacuucugaccaaacccugggaugugaucccuaugguuacacaaauugcuaugaccgacacgacacccuuugggcagcagagaguguucaaggagaaagucgauacccggaccccuaaggccaaacgcggaacagcgcaaaucauggaagugacggccagauggcucuggggcuuucugucucggaacaagaagccgagaauuuguacccgggaggaguucacacgcaaaguuagaagcaaugcugccaucggggcuguguuuauugacgagaaccaguggaacuccgccaaggaggccgucgaagacgagcgguucugggaucuugugcaucgcgaaagagagcugcacaaacagggaaagugcgcgaccugcguuuacaacaugaugggcaaacgggaaaagaagcucggggaguuuggcaaagcuaagggaucucgcgccaucugguacauguggcugggcgccagauuccuggaguucgaagcucucggguuuaugaaugaggaccacugguucagccgggaaaacucccugucuggaguggagggcgaggggcuucauaaacugggauauauccuccgcgauauuagcaagauccccggcgggaauauguacgccgacgauacagcuggcugggacaccagaauuacagaagaugaccugcagaacgaggccaaaaucaccgauauuauggaaccugagcacgcgcuucuggccaaggcuaucuuuaaacucacguaucaaaauaaggucgugcggguccagcgccccgccaagaacggaaccgugauggacguuaucuccagacgggaucagcgcggcucuggacaggugggaacauacggccugaauaccuucacaaacauggaagcucaacugauuagacagauggagagcgaggggaucuuuuccccuagcgaacucgagacccccaaccuggccgaacggguccuugacuggcuggagaaauauggaguggaaagacucaagcgcauggcgauuucuggcgaugacugugugguuaaaccgaucgacgaucgguucgccacggcucugacagcccuuaaugacauggggaaggugagaaaagauauuccucagugggagcccuccaagggcuggaacgacuggcagcaagucccuuuuugcagccaucacuuccaccagcugaucaugaaggauggacgcgagauugugguucccugucggaaucaggacgaacucgugggcagagcucgcgucucucagggggccggauggucccugcgggagaccgcuugccugggcaaaagcuacgcccaaauguggcagcucauguauuuucauagacgcgaucugcggcuugcggccaacgcuaucuguuccgccgugccugucgacugggugcccacaucuagaaccacguggagcauccacgcccaucaccaguggaugaccacagaagauaugcuguccguuuggaaucgcguguggauugaggaaaacccguggauggaggacaagacccauaucagcucuugggaggaugucccuuaccucgggaaacgggaagaccaauggugcggaucccugauuggccuuacagcuagagccaccugggcgacaaauauccagguggcuauuaaccagguucggagacugaucgggaaugagaacuaccucgacuauaugaccagcaugaagcgcuucaaaaaugaaucugaucccgagggcgcccugugguga

SEQ ID NO: 18520 - RNA, 9879 nt, Artificial Sequence
  derived and/or modified CDS sequence (opt5) from DENV-1__JQ922548__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcucuucgccaccccggcuucaccgugaucgcccuguuucucgcgcauacaauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggcccgcaauaagcccacccuggauaucgaacuccugaaaacagaggucaccaacccugcuguucuuagaaagcugugcauugaagccaaaaucucuaauacgacaaccgacucccgguguccgacccaaggagaggcgacacucguggaagagcaggaugccaacuucgugugccgcagaaccuuugucgaccggggcuggggcaauggguguggacuguucggcaaggggagccuucugacaugcgcuaaauuuaagugcgugacgaagcucgagggaaaaauuguucaguacgaaaaccugaaguauucugugaucgucaccgugcacacaggcgaucagcaucaaguugggaaugagaccacagaacacggaaccaucgccacgauuaccccccaggcuccuauguccgagauccagcugacagacuacggcgcccucacccuggacuguagcccccgcacaggccuugauuucaacgaaauggugcugcucaccaugaaagagaagucuuggcugguccauaaacagugguuucuugaccugccucuccccuggacguccggggccagcacaucccaagagaccuggaauagacaggaucugcuggugacauucaagaccgcucaggcgaaaaagcaagaagucgugguucucggaucucaggagggcgccaugcacaccgcucugacaggggccacggaaauucagaccagcggaacaaccacaauguuugccggccaccuuaagugccggcugaaaauggacaagcucacccugaaaggggcuuccuaugugauguguacgggcccguucaagcuggagaaagaagucgccgagacacagcauggaaccgugcuuguucaagugaaguacgagggcaccgaugcgccuugcaagauccccuucagcacacaggacgaaaaaggggucacccagaacggaagacucauuacagcuaauccuaucgugacggauaaggagaaacccgugaacaucgaaaccgagcccccuuuuggcgagucuuauauuguuaucggggccggagaaaaggcccugaaacuguccugguucaagaagggcagcucuauugggaaaauguuugaggcuacagcccgcggcgcucggagaauggccauccucggagacaccgcgugggauuucggcagcauugggggagccuuuacauccgucggcaagcuggugcaccagguguucgggaccgcuuacggaguccuuuuuucuggcgugagcuggacgaugaaaaucgggaucggcauucugcucaccuggcugggacugaauucccgcagcacaucucuuuccaugaccuguaucgccguuggcauggugacacucuaccugggggucauggugcaagcugacagcggaugcguuauuaacuggaagggccgggaacugaaaugugggucuggaaucuucgugaccaacgagguccauacauggaccgaacaguauaaguuucaggccgauuccccgaagagacucagcgcggccauuggcaaagcuugggaggagggggugugcggcauccgcuccgccacgcggcuggaaaauauuauguggaagcagaucucuaacgagcuuaaucacauccugcucgaaaacgacaugaaauucacaguuguggucggagacgcuaauggcauucugacccaagggaagaaaaugaucagaccccagccuauggagcauaaguacagcuggaaauccuggggaaaggccaagauuaucggcgccgaugcucagaacaccacauuuauuaucgacgggcccgauaccccugaaugucccgacgaucagcgcgcguggaauaucugggagguggaggacuauggauucggcauuuuuacgacaaacaucuggcugaaacuucgggauucuuacacccaaaugugcgaccacagacucaugagcgccgcuauuaaggauuccaaagccgugcacgccgacaugggcuauuggaucgaaagcgagaagaaugaaacauggaaacugacccgcgcuucuuucauugaggucaagacauguaccuggccgcggucccauacgcuguggagcaacgggguucucgaaucugagaugaucaucccuaagauuuacggaggccccaucucccagcacaauuauagaccuggguacuucacccagacagccggacccuggcaucugggcaaacuugagcuggauuuuaaccucugcgaagggaccacagugguggucgacgagcacugcggaaauggcggcgcgagccuggggaccacgacagugaccggaaagauuauccacgaaugguguugccggucuuguacacugccuccccuucgcuuccucggcgaggaugggugcugguacggaauggagauuagaccgguuaaagaaaaggaggaaaaccuguuucggagcaugguguccgcuggcagcggggaggucgacucuuucucccugggacuccugugugugagcaucaugaucgaagagguuaugagaucccgcuggucucggaaaaugcuuaugaccggcacccuggccguguuuuuccuccugauuaugggccaacugacauggaaugaccuuaucagacugugcauuauggucggggccaacgcuagcgaucgcaucggaaugggcacgaccuaucucgcccugauggcgacauuuaagaugagaccuauguucgcuguggggcuccuguuucggcgccuuaccuccagagagguucugcuccugacaauuggacugucucuuguggccagcgucgaacugcccaacucccucgaggaacugggcgacgggcucgccaugggaaucaugaugcugaagcuucugaccgauuuccagucucaucagcucuggacgacacugcugagccuuaccuuuauuaaaaccacacugucccucgacuacgcuuggaagaccaucgccauggugcugagcaucgugucucucuucccccugugucuuuccacaacgagccagaaaaccacauggcugccuguccugcucggcucuuuuggcuccaagccgcugaccauguuccuuauuacagagaauaaaaucugggggcggaagagcuggccccugaacgaaggaauuauggcuguuggcaucgugucuauucuccuguccagccucccuaagaaugaugugccccuggccgggccucuuaucgcgggaggcaugcugaucgccugcuaugucauuuccgggagcucugcugaccugagccucgagcgcgccgcugagguguccugggaagaggaagccgagcacucuggagccagccauaacauccugguugaagugcaagaugacggcaauaugaaaauuaaggaugaggagagagacgauucccuuaccauccugcucaaagcuacgcugcucgcggucucuggcguguaccccaugagcauuccugccacccuguucguuugguauuuuuggcagaagaaaaagcagcgguccggggugcuuugggacacacccucuccgccugaagucgugcgcgcuguccuggaugacggaaucuacagaauccugcagcggggccuccuggggcgcagccaagugggaguuggcguguuccaggacggggucuuucacaccauguggcaugugacaagaggagccguucuuauguaucagggcaaacggcuggagcccuccugggccagcgugaagaaggaucucauuucuuacggcgggggauggagauuccagggcuccuggaacaccggggaagagguccaagugaucgcuguggagccuggaaaaaaucccaagaacguucagacaacgccgggcaccuuuaaaacaccugaaggggaggucggagccauugcgcuggacuucaagcccggcaccagcggcucuccuaucgugaaucgcgaagggaaaauugugggacucuacggcaacggggucgugaccacauccggaacguauguuagcgcuaucgcccaggccaaggcuucccaagagggcccccugcccgaaauugaggaugagguguuuaagaaacggaaucuuaccaucauggaccugcacccugggucuggcaagacaagacgcuaccugccggccaucguccgggaagcgauuaaaagaaagcuccgcacccugauccuugcucccacacgggugguugccagcgagauggccgaagcucugaaaggaaugccuauuagauaucagaccacggccgugaaguccgagcacacaggccgcgaaaucgucgaucucaugugucaugcuaacuucaccaugcggcugcugagccccgugagaguuccuaauuacaacaugauuaucauggacgaggcccacuuuaccgaucccgcgucuaucgccgcucggggguauauuuccacacgcgugggaaugggcgaggccgcugccaucuucaugaccgccacaccuccggggagcgucgaagcuuuuccccagucuaaugcggugauucaggacgaggaaagagauaucccugagcggagcuggaacuccggauacgacuggauuaccgauuuccccggcaagacggugugguucgucccuucuaucaaaagcgggaacgacaucgccaauugccuccgcaagaacggcaaaagaguuauucaacuuucccggaagacauuugacaccgaauaucagaaaacaaagaauaacgauugggacuacguggugaccacggauaucucugagaugggagcuaauagcagaaccgaccgcgucauugauccccggagaugucugaagccggugauccugaaagacggcccugagcgcguuauucucgccgggcccaugcccgugacagccgcuuccgccgcgcagcggagaggacgcaucggccggaaccagaauaaggaaggggaucaauacauuuauaugggacagccucugaacaaugacgaggaucaugcucacuggaccgaagccaaaaugcuucuggacaacaucaauacacccgagggcaucauuccugcccucuucgagccggaaagagagaagagcgcugccaucgauggggaauaccgccugagaggcgaggcgcggaaaaccuuugucgaacugaugcgcagaggagaccuccccguguggcuuucuuauaagguugccuccgagggcuuccaguacagcgaucggcgcuggugcuuugacggggagagaaacaaucaggugcuggaagagaacauggacgucgaaauuuggacaaaggagggagaacggaaaaagcugagaccucgcuggcucgaugcucggaccuauuccgacccccuggcccuuagagaguucaaagaguuugcugccggccgccggucugugagcggggaucugauccucgaaauuggaaagcugccucaacaucugacgcucagagcucagaaugcccuugacaaccuggucaugcugcacaacuccgagcagggcggcaaagcguaccggcacgccauggaagagcuccccgauacaaucgaaacccugaugcuucuggcucucaucgccgugcugaccgggggaguuacacuguucuuucucucuggcaaggggcuuggaaaaaccagcauuggccugcugugcgugauggcuuccagcgugcuccuguggauggccucugucgagccgcauuggaucgccgcuuccauuauccuugaguucuuucugaaggaacuccugauuccugacgcggaugggcagcgcacaccccaagacaaucagcuggccuauguugugaucggacuccuuuucaugauccugacgguggcugccaacgagaugggccugcucgaaaccacaaagaaaaaucugggcauugggcacgucguggccgagaaccaucaccacgcuaccaugcuugauaucgaccugcauccugccagcgcguggacacucuacgccguugcuaccacgauuaucacccccaugaugagacacacaauugagaauaccacagccaacaucucucugaccgcuauugccaaucaggcggccauccugaugggacucgauaagggccggccuaucuccaaaauggacauuggggugccccuucuggcucugggauguuacagccaagucaacccgcucacgcugacagccgcugugcuuaugcuggucgcccauuaugcuaucauuggcccugggcuccaggccaaggcgacccgcgaagcccagaaaagaacagcugccggacugaugaagaaucccaccguggauggcaucgcugccauugaccuggaccccguuguguacgaugccaaguuugagaaacagcucggccaaaucaugcuucugauccugugcaccucucagauucuccugaugcggacaacgugggcgcuuugugaaagcaucacccuggcuacagggccucucaccacacugugggagggauccccgggcaaguucuggaacaccacgauugccgucucuauggcuaauaucuuccgcgggagcuaucuggccggagccggccucgcuuuuucccuuaugaaaagccuggggggaggcagacggggcacaggggcccagggagaaacccugggcgagaaguggaaacgccagcucaaccaacuguccaagucugaguucaauaccuacaagagaagcgggauuauggaaguggaccgguccgaggcgaaagaaggacuuaagagaggcgagacaaccaaacacgccguuucucgcgggacagcuaagcugcggugguuuguggaaagaaaccucgucaaacccgagggaaaggugaucgaucugggcugcggccgcgggggauggagcuauuacugugccggccugaagaaagugacggagguuaagggguauaccaaaggaggcccugggcaugaagagcccaucccuauggcuacauacggauggaaucucgucaagcuucacuccggcaaagacguguucuuuacccccccugaaaagugcgauacacugcugugugacauuggcgagucuagcccgaaccccaccaucgaagaggggcggacgcucagagugcugaaaauggucgagccuuggcuucgcggaaaucaguucugcauuaagauccugaaccccuacaugccuuccguuguggaaacccucgagcagaugcagcggaagcacggcgggaugcuggugagaaacccccugagccgcaauucuacacaugaaauguauugggucuccugugccaccggaaacauugugagcgcgguuaauaugacaucucggaugcuccugaacagauuuaccauggcccaccgcaaaccgacauacgagcgggauguggaccuuggcgcugggaccagacaugucgccguggagccugaaaucgcuaaucuggauauuaucggacaacgcaucgagaacauuaagaaugaacacaaauccacguggcacuaugacgaggauaaccccuacaagacaugggccuaucauggcaccuacgaaguuaaacccagcggcucugcuuccagcauggugaauggggucgugagacuccugaccaagccuugggacgugauccccauggucacacagauugccaugacggacaccacaccuuucggacagcaacggguuuuuaaggagaaaguggauacccgcacaccgagacccaagcggggcaccgcgcagaucauggaggugacagccagauggcuuuggggguuccugucccggaacaaaaagccucgcauuugcaccagagaagaguuuacgcggaaaguccgcagcaaugcugccaucggagcuguguucguugacgaaaaccaguggaauucugccaaggaggccguggaagaugagagauuuugggaccucguccaccgggagcgcgaacugcauaagcagggcaaaugugcgaccugcguguauaacaugauggggaagagagagaaaaagcugggcgaauucggaaaagcuaagggcagccgggccaucugguacauguggcucggggcccgcuuccuggaguuugaagcucuuggauucaugaaugaggaucacugguuuuccagagagaacucucugagcggcguugaaggggagggacuccauaagcugggcuacauucuucgggacaucuccaaaauucccgggggcaacauguaugccgaugacacagcuggaugggauacccgcaucacagaagacgaucugcaaaaugaggccaagauuaccgacaucauggagccugaacacgcgcuccuggccacgucuaucuucaaacugacauaccagaacaagguggucagagugcagcggcccgcuaaaagcggcaccguuauggaugugauuucccgcagagaccagcgggggucuggacaagucggcacauaugggcucaauaccuuuacgaacauggaggugcagcugaucagacagauggaaagcgagggaauuuucuccccgagcgaacuugagaauucuaaccuggccgagcgcgcucucgacuggcuggaaaagcacggcgucgagcggcuuaaaagaauggccaucuccggggaugacugcgugguuaagccuaccgaugaccgcuuugcgacagcccugaccgcucucaaugauaugggcaaggugcggaaagacauuccccagugugaaccuagcaagggauggaacgauuggcaacagguccccuucugcucucaucacuuucaucagcugaucaugaaagacggcagagagaucguggugccuugucgcaaucaggaugaacugguugggcgggccagagugucccaaggagcuggcuggagccuccgcgagacagccugccuggggaaguccuacgcucagauguggcagcuuauguauuuccaccggagagaccugcgccucgccgcgaacgccauuuguucugcuguccccgugaauuggguuccgaccagccggacaaccugguccauccacgcccaucaccaauggaugacgacagaggauaugcugagcguguggaacagagucuggauugaagagaauccuuggauggaagacaaaacccaugugucuuccugggccgacguccccuaccuuggaaagcgggaggaucaguggugcggcagccugaucgggcucgcugccagagcgaccugggcuacaaacauucagguggcccugaaucagguucgccggcugaucggcaacgaaaacuaucucgacuacaugaccucuaugaagagauuuaaaaaugagagcgaucccgagggagcccugugguga

SEQ ID NO: 18521 - RNA, 9879 nt, Artificial Sequence
  derived and/or modified CDS sequence (opt5) from DENV-1__JQ922544__SS-prME
uccgugaccaugcugcucaugcugcuucccaccgcucuggcuuuccaccucacgacccggggcggggaaccucauaugaucgucuccaagcaggaacggggaaagucucugcuuuuuaagaccagcgccggcguuaacaugugcacccugauugcgauggaccucggggaacugugugaagauacaaugaccuacaaaugcccgcgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacaagaaccgaaacguggaugagcugcgagggcgccuggaaacagauucagaagguugaaaucugggcccuucggcaccccggcuucacagugauugcccuguuucucgcgcaugccaucgggaccuccaucacacagaagggaauuaucuucauucugcuuaugcuggucaccccuucuauggcuaugcgcugugugggcaucgggaacagagaguuuguugagggacucagcggcgccaccuggguggaugucgugcuggaacacggguccugccugcacacaauggcucaaaauaaacccacgcucgacauugagcugcuuaagaccgaagugacaaacccugccguccugcggaaacucuguaucgaggcgaagauuagcaauaccacaaccgauucucgcugcccgacgcagggagaagccacacugguugaggagcaggacgcuaacuucguguguagacggaccuuuguggaucgcggcuggggcaaugggugcggacuuuucggcaaagggucccugcucacaugcgccaaguuuaagugugucacaaaacuggaaggaaagaucgugcaguacgagaaccugaaauauagcguuaucgugaccguccauacaggcgaccaacaccagguggggaaugaaacgaccacacauggaaccauugcuacaaucacaccccaggccccuacgucugagauucagcucaccgauuacggcgcccugacacuugacugcucccccagaaccggccuggacuucaacgaaaugguucuccugacaaugaaggagaaaagcuggcuugugcacaagcaaugguuucuggaucucccucugcccuggaccucuggggcuuccacgagccaggagacauggaaucggcaggaccugcucgucaccuucaaaacagcgcacgccaagaagcaagaaguggucgugcugggaucccaggagggcgcuaugcauaccgcccuuaccggggccacagaaauccagacgucuggaaccacaaccauuuuugcuggccaccugaaaugucgccucaagauggauaaacugacacugaaggggaugagcuauguuaugugcaccggcuccuucaaacuugagaaggaaguggccgagacgcagcauggaacaguccucgugcaaguuaaguacgagggcaccgacgcgccguguaaaaucccuuucagcacccaggaugaaaagggggugacacagaacggaagacugaucaccgcuaaucccauugucacagacaaagagaagccugugaacaucgaagccgagccgcccuuuggcgagucuuauauugugguuggggccggagaaaaagcucugaagcucuccugguucaagaaaggcagcucuaucgggaagauguuugaggccacggcucggggcgccagacgcauggcgauucugggagauaccgccugggacuucggcagcaucgggggagucuuuacauccgugggcaaacuugugcaccaggucuucgggaccgcuuacggagugcuguuuucuggcguuagcuggaucaugaagauugggaucggcauucuccugacauggcugggacuuaauucccggagcaccucucucuccaugacgugcaucgccgugggcauggucacccuguaccugggggugaugguucaagcugauagcggaugugugauuaacuggaaaggcagagaacucaagugcgggucuggaaucuucgucacaaacgaggugcauaccuggacagaacaguauaaguuucaggccgacuccccuaaacgccugagcgcggccauuggcaaggcuugggaggaggggguuuguggcauccgguccgccaccagacuugaaaauaucauguggaaacagauuucuaacgagcugaaucacauccuccuggaaaacgauaugaaguucacaguggucgugggagacgcuaauggcauucuggcccaagggaaaaagaugauccgcccgcagcccauggagcacaaauacagcuggaaguccuggggaaaggccaaaauuaucggcgcugacauccagaacaccacguuuauuaucgaugggccugacacacccgaaugcccugaugaccagcgggcguggaauauuugggagguggaggauuauggauucggcaucuuuaccaccaacauuuggcuuaagcucagagacucuuacacacaaaugugugaucaucgccugaugagcgccgcuaucaaagacuccaaggccguccacgccgauaugggcuauuggaucgaaagcgagaaaaaugaaaccuggaagcuggcucgggccucuuucauugagguuaagacgugcaucuggcccaaaucccauacacucuggagcaacggggugcuggaaucugagaugauuaucccgaagauuuacggaggcccuaucucccagcacaauuauagacccggguacuucacccagacagcgggaccuuggcaccuuggcaaacuggagcucgacuuugaucugugcgaagggaccacaguggucguggaggaacauuguggaaaccgcggccccagccugcggaccacgaccguuacaggcaagaucauucacgaguggugcuguagaucuugcacccuuccuccccuccgguucaaaggggaggacggauguugguacggcauggaaauccgcccggugaaggagaaggaagagaaucuggucagaagcaugguguccgcugggagcggagaaguugauucuuuuucccugggccuccugugcgugagcauuaugaucgaggaggucaugcgguccagauggucucgcaaaaugcuuaugacagggacccuggccguguuccuccugcugauuaugggacaacuuacguggaacgaccugauccggcucuguauuaugguuggcgccaaugcuagcgacagaaugggcauggggacaaccuaucuggcccucauggcgacauuuaagaugcgcccuauguucgcugugggacugcuuuuuagacggcugaccucccgcgaaguccuccugcugaccaucggccuuucucugguggccagcguggagcuccccaacucccuggaagaacuuggggauggacuggccaugggcaucaugaugcuuaaacugcucacagacuuccagucucaucagcuguggacgacccugcuuagccugacauuuauuaagaccacacucucccuggauuacgcuuggaaaaccauggccaugguccucagcaucguuucucuguucccccuuugccuguccacgacaagccagaagaccaccuggcugccugugcuccuggggucuuuuggauguaagccgcuuacaauguuccugauuaccgaaaacaaaaucuggggcagaaaguccuggccccucaaugagggcauuauggcuguggggaucgucagcauccugcucucuucccugcuuaaaaacgacgugccucuggccggaccccugauugcgggcgggaugcucaucagcuuuuucguuauuuccggaagcucugccgaucugagccuugagaaggcugccgaaguguccugggaggaagaggcugaacacucuggcacaagccauaauauccuggucgaggugcaagacgaugggacgaugaaaauuaaggacgaggaacgggaugacacccucacaauccugcucaaagccacccugcuugccguuuccggaguguauccuaugucuauccccgcuacacuguucgucugguacuuuuggcagaagaagaaacagcgcagcggcgugcugugggauaccccuagcccucccgaggucgaaagagcggugcucgacgauggcauuuaucggauccugcagcgcgggcuucugggaagaucucaaguuggcgugggggucuuccaggacggaguguuucacacgauguggcacguuacccggggcgccgugcucauguaccaggggaagcgccuggagcccagcugggcuuccgucaaaaaggaccucauuagcuauggaggcggcuggagauuccaggggucuuggaacacaggagaggaagugcaagugaucgccguugagcccggcaaaaauccuaagaacguccagaccacacccgggaccuuuaagacaccggaaggagaggugggcgccauugcucuggauuucaaaccugggacguccggaagccccaucgugaaucgggaaggcaagauugucggccuuuacgggaacggagugguuaccacaucuggcaccuacguguccgccaucgcgcaggcuaaagccagccaagaggggccucugcccgagaucgaagacgaggucuuuagaaagcgcaaucugaccauuauggaucuccaucccggauccggcaaaacacggagauaucugccugccaucgugcgcgaagcuauuaagcggaaacuuagaacgcugauccucgccccgacccgcguuguggcgucugagauggcugaagcccugaaagggaugcccauucgguaccagacaaccgccgucaagagcgagcacacaggcagagagaucguggaccugaugugccaugcuaccuucacgaugcgccuccuuuccccuguucgggugcccaacuauaauaugaucauuauggaugaagcccacuuuacagacccugcuagcaucgccgcgagaggauacauuucuacccgggucggcaugggggaggccgcugccaucuucaugaccgcuacacccccuggauccguggaagccuuuccgcagagcaacgccgugauucaggaugaggaacgcgacauccccgagagaucuuggaauagcggcuaugauuggaucaccgacuucccugggaaaacagucugguucguucccuccauuaagucuggaaacgauaucgcuaauugucugcggaaaaacggcaagcgcgugauucaacugagcagaaagaccuuugacacggaguaccagaaaacaaagaacaaugacugggauuauguggucaccacagacaucuccgaaaugggggcgaacuuccgggccgauagagugauugacccucgccggugccucaaacccguuauccugaaggauggcccggagagagugauucuugcuggaccuaugcccgucaccguggccucugccgcucagcgccggggcagaaucgggcgcaaucagaacaaagaaggagaccaauacguuaauaugggccagccccugaacaaugaugaggaccaugcccacuggacggaggcgaagaugcuccuggauaacaucaauaccccugaagggauuauccccgcucuguuugagccugaacggaagaaaagcgccgccguggacggagaguacagacuccgcggcgaagcuagaaagacauucgucgagcuuaugcggcgcggggaucugccgguguggcuguccuauaaagucgccagcgagggcuuucaguacucugacagacgguggugcuucgauggagaacgcaacaaucaggugcucgaggaaaacauggacguugagauuuggaccaaggaaagagagcggaaaaagcugagaccccgcuggcuugacgcgcggacauauuccgauccucuggcccucagagaguuuaaagaguucgcugccggccgccggagcguguccggggaccugauccuggagauuggaaagcucccccaacaccuuacccugagagcucagaaugcccuggauaaccucgugaugcugcauaauucugaacagggcgggaaggcuuaccggcacgccauggaggaacuuccugacacaaucgagacccugaugcuccuggcgcugaucgccguccucacgggaggcguuacacucuuuuuccugagcggcaaagggcugggaaagaccuccauuggccuccugugugugauggcuucuagcgcccuucuguggauggcuuccguggagccccauuggaucgccgccagcauuauccucgaauuuuuccugaugguccugcucauuccggagccugaucgccagagaacaccccaagacaaccagcuugcuuaugugguuaucgggcugcuguuuaugauccucacaguggcggccaacgaaaugggacugcuugagaccaccaagaaggaucugggcauugggcacgucgcugccgagaaucaccaucacgccacgaugcucgacguggaucugcggccugcuucugccuggacccuguacgcggucgccacaaccaucauuacacccaugaugcgccauaccaucgaaaacacgaccgcuaauauuucccucacagccaucgcuaaccaggccgcgauucuuaugggacuggacaaaggcuggccuaucagccugauggauaucggcgugccccuccuggcccuugggugcuauucucaaguuaauccgcugacccucacagcugccgugcugaugcuggucgcucacuacgccauuaucggaccuggccuccaggcuaaggccaccagagaggcgcagaagcggacggccgcugggauuaugaaaaaccccacaguggacggaaucguugccauugaucuugaccccguggucuacgacgcuaaguucgaaaaacagcugggccaaaucaugcugcucauccuguguaccucccagauucuucugaugcgcacaaccugggcccucugcgagagcaucacccuggccacagggccucugacgacccucugggaaggaucuccgggcaaguucuggaauacaaccauugcggugagcauggcuaacaucuuuagaggcuccuaucuugccggggcuggacuggccuucucucugaugaaaagccucggcgggggacggcgcggcacaggggcccagggagagacccugggcgagaaguggaagagacagcuuaaucaacuguccaaaagcgaauuuaacauuuacaagcgguccggcaucauggagguggauagaucugaagcuaaagaggggcucaagcgcggagaaacgacaaaacaugccguuagccggggcaccgcgaagcugagaugguucgucgagcgcaaucuggugaagcccgaggggaaagugaucgaccucggauguggcagagggggaugguccuauuacugcgccggccuuaagaaagucaccgaaguuaagggcuauacaaaagggggaccuggccacgaggaacccauuccuauggcuaccuacggguggaaccuggugaagcugcacucuggaaaagauguguuuuucacacccccugagaagugugacacgcuccugugcgauaucggcgaaagcuccccgaaucccaccauugaggaggggagaacacuucgcguccugaagaugguggaaccuuggcuccggggaaaccaguuuuguaucaaaauucugaaucccuauaugccuucuguuguggagacccuggaacagaugcagagaaagcauggcggcaugcucguccgcaacccccugagcagaaauuccacacacgagauguacugggugagcugcgggaccggaaacaucguuucugccgugaacaugacguccagaaugcuucugaaucgcuucaccauggcucaucggaaaccgacauacgagagagacgucgaucucggcgccgggacccgccacguggcgguggaaccugaggucgccaaccuggacauuaucggacaaagaaucgaaaauauuaagaacgagcacaaaagcacauggcauuaugaugaagacaaucccuacaagaccugggcuuaucacggcucuuacgagguuaagcccuccgggagcgccucuuccauggugaacggagugguccggcuucugacaaaaccuugggaugugauccccaugguuacccagauugcuaugacggacacaaccccuuuuggccagcaacgcguguucaaggagaaagucgacaccagaacaccgcgggccaagagaggcacggcucagaucauggaagugaccgccaaauggcucuggggguuucugagccggaauaagaagccccgcauuuguacaagagaggaguucacccggaaaguucgcuccaacgcggccaugggagcuguguuugucgaugagaaucaguggaacagcgccaaggaagcuguggaggacgagagauucugggaucugguucaucgggaacgcgagcuccacaaacagggcaagugcgccacaugcguguauaauaugauggggaaaagagaaaagaagcugggagaguucggcaaagccaaggggucucgggcgaucugguacauguggcuuggcgcucgcuuucuggaguucgaggcccucggauuuaugaacgaggaccauugguucagcagagaaaauucccugucuggcgucgagggggaaggacuucacaaacugggcuauauccuccgggauauuagcaagaucccugggggaaacauguacgccgacgauaccgcuggcugggacacacgcauuaccgaggaugaccugcaaaaugaggccaaaaucacggauauuauggaacccgagcacgcucugcucgccaccuccaucuuuaagcugacauaccagaacaaaguggucagagugcagcggccugcgaagucugggaccguuauggacgugaucagccgcagagaucagcggggcuccggacaagucggcacauaugggcuuaacaccuucacgaauauggaagugcagcugauuagacagauggagucugaaggaaucuuucuccccagcgagcuggagacaccgaaccuugccgaacgcgugcuggacuggcucgagaagcauggcgcugaacggcugaaaagaauggccauuuccggggacgauuguguugugaagccuaucgacgaucgcuucgcuaccgcccugacagcgcucaaugacaugggaaaaguccggaaggauauuccccagugggagccuagcaaaggcuggaacgacuggcaacaggugcccuuuugcucucaccauuuccaccagcugaucaugaaggaugggagagaaaucguugugccuugucgcaaucaggacaaacuugucggccgggccagagugucccaaggagcuggcuggagccugcgcgagaccgccugccucgggaaaucuuacgcucagauguggcagcugauguauuuucaccggagagaucuucgccuggccgcuaacgccauuuguuccgcgguccccguggacuggguuccgacgagccggaccacaugguccauccaugcccaccaucaauggaugaccacagaggauaugcucucuguguggaauaaggucuggauugaagagaacccuuggauggaagacaaaacccacgugagcuccugggaggacguucccuaccugggaaagagagaagaucaguggugcggcagccugaucgggcucacagcucgggccaccugggccacgaauauucagguggcuaucaaccaggucagacgccugauuggaaaugagaacuaucuugacuacaugacaucuaugaaacgguucaagaaugaguccgaucccgaaggcgcccugugguga

SEQ ID NO: 18522 - RNA, 9879 nt, Artificial Sequence
  derived and/or modified CDS sequence (opt5) from DENV-1__JQ922546__SS-prME
agcguggccaugcugcucaugcugcuucccaccgcucuggccuuccaccucaccacgagaggcggggagccucauaugaucgucuccaagcaggaacggggaaaaucucugcuuuuuaagaccagcgcgggcguuaauaugugcacccugauugcuauggaccucggggagcugugugaagauaccaugacauacaaauggccgcgcaucaccgaggccgaacccgacgauguggacugcugguguaaugccacagauaccugggugacguauggaaccugcucccaaacaggcgagcacagacgggacaagcgcucugucgcucuggccccucauguggggcucggacuggagaccagaacagaaaccuggaugagcuccgagggcgcuuggaaacagauucagaagguugaaacgugggcccuucggcaccccggcuucacagugaucgcgcuguuucucgcccaugcuauugggaccucuaucacacagaagggaaucauuuucauccugcuuaugcuggucaccccuagcauggccaugcgcugugugggcauugggaacagagauuuuguugagggacucuccggcgcuaccuggguggacgucgugcuggagcacgggagcugcgugacaacgauggccaaaaauaagcccacccuggauaucgaacuccugaaaacagaggucaccaacccugcgguucuucggaagcuguguauugaagccaaaaucucuaauacaaccacggacucccgcugcccgacacaaggagaggcuacccucguggaggaacaggaugccaacuucguguguagacggaccuuugucgaccgcggcuggggcaaugggugcggacuguucggcaaggggagccuucugacaugugcuaaguuuaaaugcgugaccaagcucgagggaaaaauuguucaguacgaaaaccugaaguauucugugaucgucacagugcacacgggcgaucagcaucaaguugggaaugagaccacagaacacggaaccaucgccauuaucacaccccaggccccuaccuccgagauucagcugacggacuacggcgcucucacccuggacugcagccccagaacaggccuugauuucaacgaaauggugcugcucaccaugaaagagaagucuuggcugguccauaaacagugguuucuugaccugccucuccccuggacauccggggcgagcaccucccaagagacguggaaucggcaggaucugcuggugacauucaagaccgcccacgcuaagaaacaggaagucgugguucucggaucucaagagggcgccaugcacacagcccugaccggggcuaccgaaauccagacaagcggaacgaccacaauuuuugccggccaucuuaagugucgccugaaaauggacaagcucacccugaaagggauguccuaugugaugugcacaggcagcuucaagcuggagaaggaagucgcggagacccagcacggaacggugcuuguucaggugaaauacgagggcacagaugcuccguguaagaucccuuucucuauccaagacgaaaaaggggucacccagaacggaagacucauuaccgccaaucccaucgugacagauaaggagaaaccugugaacauugaaaccgagccgcccuuuggcgaguccuauaucguugucggggccggagaaaaggcucugaagcugagcugguucaaaaagggcucuagcauugggaaaauguuugaggccacagcucggggcgccagacgcauggcgauccucggagacacggccugggauuucggcuccaucgggggaguguuuaccucugugggcaagcugguccaucagguguucgggacagcuuacggaguucuuuuuagcggcguguccuggaccaugaaaauugggaucggcauucugcucacauggcugggacugaauagccggucuaccucccuuagcaugacgugcaucgccgucggcauggugacccucuaccuggggguuauggugcaggcugacucuggaugugucauuaacuggaagggcagagaacugaagugcggguccggaaucuucgugacaaacgagguucacaccuggacagaacaauauaaauuucaggccgauagcccuaagcgccucuccgcggccauuggcaaggcuugggaggaggggguguguggcauccggucugccaccagacuggaaaaugucauguggaagcagaucagcaacgagcuuaaucauauucugcucgaaaacgacaugaaauucacagugguggucggagacguuaauggcauccuggcucaggggaagaaaaugauucgcccgcaacccauggagcacaaguacuccuggaagucuuggggaaaagccaagaucauuggcgccgauauccagaacaccacguuuaucauugacgggccugauacacccgaaugcccugacgaucagcgggcuuggaauaucugggagguggaggacuauggauucggcauuuuuaccaccaacaucuggcugaaacuuagagauagcuacacacaggugugugaccaccgccucauguccgcggccauuaaggauagcaaagcuguccaugccgacaugggcuauuggaucgaaucugagaagaaugaaaccuggaagcuggcccgggcuuccuucaucgaggugaaaacgugcacauggcccaagagccacacccuguggucuaacgggguucucgaauccgagaugauuaucccgaaaauuuacggaggcccuaucagccaacauaauuauagacccggguacuucacacagaccgccggaccuuggcaccugggcaaacuugagcuggauuuugaccucugugaagggacaaccguggucguggaugagcacugcggaaaccgcggccccucucugcggacgaccacaguuaccggcaaaauuauccaugaauggugcuguagaagcugcacacugccuccccuucgguucaagggggaggacggauguugguacggcauggagauccgcccggugaaggaaaaagaggaaaaucucgucagauccauggugagcgcggggucuggagagguugacuccuuuagccugggccugcucugcguguccauuaugaucgaagaggucaugcggucuagauggagccgcaagaugcugaugaccgggacgcuugcuguguucuuucugcucauuaugggacagcugacauggaacgaucuguuccggcuuuguaucauggugggcgccaaugccuccgacagaaugggcauggggaccacauaucuggcucucauggccaccuuuaaaaugcgcccuauguucgcggucggacugcucuuuagacggcugaccucucgcgagguucuucugcucacaauuggccugagccugguggcuuccguggaacuucccaacucucuggaggaacucggggauggacuggccaugggcaucaugaugcucaagcugcuuacggacuuccaaagccaccagcuguggaccacacuccugucccugaccuuuauuaaaacaacccuuagccuggauuacgccuggaagacgauggcuaugguccucucuaucgugucccugagcccccucugccugucuacaaccucccagaagaccacauggcuuccuguucugcuggggagcuucggauguaaaccgcucaccauguuucugaucacagagaacaagauuuggggcagaaaaucuuggccccuuaaugaaggcaucauggccguggggauugucuccauccugcucagcucccugcucaagaacgacgugccucuggcuggaccccuuauugccggcgggaugcugaucgcgugcuauguuaucagcggaucuagcgccgaucugucccucgagaaagcugccgaggugucuugggaagaggaagcugagcauagcggcgccucccacaauauucuggucgaagugcaggacgaugggacgaugaagaucaaagacgaggagcgggaugacacccuuacaauucugcucaaggccucucugcucgcugucagcggaguguacccuauguccauccccgcgacccuguucguuugguauuucuggcaaaagaaaaagcagcgcucuggcgugcuuugggauacaccuagcccucccgaagucgagagagccgugcuggacgacggcauuuaccggauccugcagcgcgggcuccugggaagaucccagguuggcguggggaucuuucaagauggagucuuccauaccauguggcacgugacgcggggcgcugugcuuauguaucaggggaaacgccuggaacccagcugggccucuguuaagaaagaccucauuuccuacggaggcggcuggagauuucaggggagcuggaacaccggagaggagguccaggugaucgccguggaacccggcaagaauccuaagaacguccaaacaacccccgggauuuucaaaacaccggagggagaagugggcgcuaucacccuggauuuuaagccugggacaucuggaucccccauuguuaaucgggagggcaaaaucgugggccucuacgggaacggagucgugacgaccagcggcacauauguuuccgccauugcgcaggcuaaggccucucaggaagggccucugcccgagaucgaggacgaaguguucagaaaacgcaaucuuaccaucauggaucugcaccccggaagcggcaagacccggagauaccugccugccauuguccgcgaggcuaugaagcggaaacucagaacacugauccuugccccgacgcgcgugguugcguccgaaauggcugaggcccugaaggggaugcccauucgguaucaaaccacagccgugaaaagcgaacauaccggcagagagaucgucgaccucaugugucacgcuacauuuaccaugcgccugcugucuccugugcgggugcccaacuacaauaugauuaucauggaugaggcccauuucacggacccugcuuccaucgccgcgagaggauauauuagcacacgggucggcaugggggaagccgcugccaucuuuaugaccgcuacacccccuggaucuguugaggccuucccgcagagcaacgccgugauucaggaugaagaacgcgacauccccgaaagauccuggaacucuggcuacgauuggauuacagacuuuccugggaagaccgugugguucguccccagcaucaaauccggaaacgacaucgcuaauugccuccggaagaacggcaagcgcgugauucagcuuucuagaaaaacauucgauaccgaguaucaaaagacgaaaaacaaugacugggauuacguugugacaaccgacaucagcgagaugggggcgaacuuucgggccgauagagucauugacccucgccggugucugaagcccgugauccugaaagaaggcccggagagaguuauucucgcuggaccuaugcccgugacagucgccuccgccgcucagcgccggggcagaaucgggcgcaaucagaacaaggaaggagaucaguacguguauaugggccaaccccugaauaacgacgaggaucacgcccauuggaccgaggcgaagaugcuucuggaccacauuaauacgccugaagggaucauccccgcucucuucgagccugaacgggagaaaagcgccgccauugauggagaauacagacugcgcggcgaggcuagaaagaccuuugucgagcugaugcggcgcggggaccucccgguguggcuuucuuauaaaguugccuccgaaggcuuccaguacacagauagacgguggugcuuugacggagagcgcaacaaucaggugcuggaagagaacauggacguggaaaucuggauggaggagggcgaaaagaaaaagauuagaccccgguggcuggagaucgaaaaauauagcgauccucucgcgcugagagaguucaaggaauuuuccgccaagcgcaaaucuguccuuggggaccugaagcucgagauuggaaaacugccccagcaccugaccaucaaggcucggaaugcccucgauaaccuuguuaugcugcauaauagcgagcaaggcgggaaggcuuacagacacgccauggaggaacugccugacacaaucgaaacccucaugcgccugggacuuauugcugugaugacaggcggcgugacccuguucuuucucuccgggaagggacugggcaagacgucuaacgggcugcucugcgucauggccagcuccgugcuucuguggauggcgagcguugagccccauuggaucgccgcuucuauuauccuggaguucuuucucauggugcugcuuauuccggaaccugaucggcagagaacaccccaggacaaucagcuggccuaugucgugaucggacuccuguucaugauccugaccgucgcugccaacgagaugggccuccuugaaaccaccaagaaggaucuggggauuggacacgugguugccgagaaccaccaucacgcuaccaugcuggacguggaucuccauccugcguccgccuggacacuguacgcugucgccacgaccaucauuacacccaugaugcggcacaccaucgaaaauacaaccgccaacauuagccuuacggcuaucgccaaucaagcggccauucugaugggccucgacaaaggcuggccuaucucuaagauggauaucggggugccccugcuggcucucggauguuacucccagguuaacccgcuuacccugacagccgcugugcugaugcucgucgcccauuaugcgauuaucggcccugggcugcaggccaaagcuacccgcgaggcccaaaagagaacagcuccccagauuaugaagaaucagaucguggacggaauuguggccguugaucuugaccccgucguguacgacgcuaaauuugagaagcagcugggccaaaucaugcuccugauccugugcaccagccagauucuccuuaugcggacgacaugggcccugugugaaucuaucacccuggcgacagggccucucaccacccugugggagggaagcccgggcaaauucuggaacacaacgauugccguguccauggcuaauaucuuccgcggcucuuaucuugccggggcuggacuggccuuuagccucaugaagucccugggcgggggaagacggggcaccggggcccagggagaaacacugggcgagaaauggaagcgccagcucaaccaacuuagcaaguccgaguucaauaccuacaaaagaucuggcauuauggaggucgaucggagcgaggcgaaggaagggcugaaacgcggagagacaaccaagcacgcuguuuccagaggcacggccaaacugcggugguuuguggaaagaaaccucgugaagcccgaggggaaagucaucgaccugggaugcggccgcgggggauggucuuauuacugugcuggccuuaagaaggugacagaaguuaaaggcuauaccaaagggggaccuggccacgaggagcccaucccuauggccaccuacggguggaaucuggugaaacuccauagcggaaaggaugucuucuuuacacccccugaaaaaugcgacacccugcugugugauauuggcgaguccucuccgaaccccacaaucgaagaggggcggacgcucagagugcuuaagaugguugagccuuggcugcgcggaaaucaguucugcauuaagauccugaaccccuacaugccuagcguggucgaaacccucgagcagaugcagcggaaacacggcggcaugcuggugagaaauccccuuucccgcaacagcacacaugaaauguauugggugucuugugggaccggaaauauugucuccgccguuaacaugacaagccggaugcugcucaacagauuuaccauggcucaccgcaagccgacguacgagcgggacguggaucugggcgccgggaccagacacguggcggucgaaccugagguggccaaucuggacaucauuggacaacgcaucgagaacaucaaaaaugaacauaagucuacauggcacuaugaugaggacaaccccuacaaaaccugggcuuaucauggcuccuacgaaguuaagcccagcgggucugccuccagcauggugaauggagucgugcggcuccugacaaagccuugggauguuauucccaccgugacacagaucgcuaugaccgacacgacaccuuucggccagcaaagagucuuuaaagagaagguggacacccgcaccccgaaagccaagagaggcacagcgcagauuauggaaguuacggccaacuggcuuuggggguuccugucccggaauaaaaagccccgcaucugcaccagagaggaguuuacacggaaggugagaagcaacgcugccauuggagcugucuucguggaugaaaaucaguggaacucugccaaagaggcugucgaagacgagcgguuuugggaucucgugcaccgcgaaagagagcugcauaagcagggcaaaugugcgaccugcguuuauaauaugauggggaagcgggagaagaaacuuggagaguucggcaaagccaaagggagccgcgccaucugguacauguggcugggcgcuagauuccucgaguuugaagcccugggauucaugaacgaggaccacugguuuucccgggaaaauucucugagcggcguggaaggggagggacuccacaagcugggcuacauccuucgcgauauuuccaaaaucccugggggaaacauguaugcugacgauacagccggcugggacaccagaauuacagaagaugaccugcaaaaugaggccaagaucaccgauauuauggaacccgagcaugcgcuccuggcuacgucuaucuucaaacuuaccuaccagaacaaggucgugcgggugcagcgcccugccaaaagcgggacaguuauggacgugaucuccagacgggaucagcgcggcucuggacaagucggcaccuaugggcugaacacauuuaccaauauggaggugcagcucauuagacagauggaaagcgagggaaucuuccugcccuccgaacuggagacgccgaaccucgccgaacggguucugaauuggcuugagaagcacggcguggagcgccugaagagaauggcuauuagcggggacgacugcgucgugaaaccuacagaugaccgguuugccaccgcucucacagcccugaacgauaugggaaaggucagaaaagacacaccccagugggaaccuucuaagggcuggaaugauuggcaacaggugcccuucuguucccaucacuuucaccagcuuaucaugaaagacgggcgcgagauuguugugccuugccggaaccaggaugaacuggucggcagagcgcgcgugagccauggagccggcuggucucuccgggagacggcuugucuggggaaguccuacgcccaaauguggcagcugauguauuuccacagacgcgaccuccggcuggcugccaaugcgaucugcagcgccguucccguggauugggucccgaccuccagaacaaccuggucuauccaugcucaccaucaguggaugacaaccgaagacaugcuuagcguguggaaccgcguguggauugaggagaauccuuggauggaagauaagacacacguuuccagcugggaggacguccccuaccugggaaaacgggaagaccaaugguguggcucuaucauugggcucaccgccagagcuacgugggccacaaacauccagguggcuauuaaucaggugcgccggcugaucggaaacgagaauuaucuugauuacaugaccuccaugaagagauuuaaaaacgagagcgaccccgaaggcgcccugugguga

SEQ ID NO: 18523 - RNA, 9879 nt, Artificial Sequence
  derived and/or modified CDS sequence (opt5) from DENV-1__JQ922545__SS-prME
agcgugaccaugcugcucaugcugcuucccaccgcucuggcuuuccaccucacgaccagaggaggggagccucauaugaucgucuccaagcaggaacggggaaaaucucugcuuuuuaagaccagcgccggaguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggcggcagauucagaaaguugaaacaugggcccuucgccaccccggcuucaccgugaucgcccuguuucucgcgcauacaauugggaccucuaucacccagaagggaaucauuuucauccugcuuaugacaggcgccccuauuauggcuaugagaugcgucgggaucggaaaccgggauuuuguggagggccugagcggggcccccuggguugacgugguccucgagcacggauccugucugagcaauauggcuaagaacaaaccuacgcuggauauugacuucuuuaagaccgaagugacaaauccggccgugcuccgcaaacugugcaucgaggcgaagauuucuaacaccacaaccgauuccagaugucccacgcaaggcgaagccacacuugucgaggaacaggacgcuaauuucguuugccggcgcaccuuuguggauagaggcugggggaacggauguggccuguucgggaaaggaagccuccugaccugcgccaaguuuaagugcgugacaaaacuugagggcaagaucguccaguacgagaaucugaaauauucugugaucguuaccgugcacacaggggaccagcaucaagucggaaacgaaacgaccgagcacggcacaauugcuaccaucacaccucaggcccccaccuccgaaauucagcucacggacuacggcgcccugacccuggauuguagcccucggacagggcucgacuucaaugagauggugcugcuuaccaugaaggaaaaaucuuggcugguucauaagcagugguuucucgaucugccccuuccguggacauccggagcuagcaccucccaagagacguggaaccgccaggaccugcucgugacauucaaaaccgcgcacgccaagaagcaggaggucgugguccugggcucucaagaaggggcuaugcacacagcccugaccggagccaccgagauccagaugagcggcacaacgaccauuuucgcugggcaucucaaaugcagacugaagauggauaaacuuacacugaagggcguguccuauguuauguguaccggcagcuuuaaacucgaaaaggagguggccgaaacacagcacggcaccguccuggugcagguuaaguacgaggggacggacgcgccuugcaaaauccccuucucuacacaagaugagaagggagugacccagaauggccggcugaucaccgcuaacccuauugucacagacaaagaaaagcccgugaauaucgagaccgaacccccuuuuggggaguccuauauugugaucggagccggcgagaaagcccuuaagcucagcugguucaagaaagggucuagcauuggcaagauguuugaagcuacagccagaggagcucgccggauggccauccugggcgauacggcgugggacuucggguccaucggaggcguuuuuaccucugucgggaaacuggugcaucagguguucggaacagccuacggcguccucuuuagcgggguguccuggaccaugaagauuggcaucggcauucuccuuacauggcugggacucaacagcagaucuaccucccugagcaugacguguaucgcuguugggauggugacccuguaccuuggagucauggugcaggccgauucuggcugcguuauuaacuggaaagggcgcgagcucaaguguggauccggcaucuucgugacaaaugaaguccacaccuggacagagcaauauaaguuucaggcugacagcccgaaacggcuguccgccgcgauugggaaggccugggaagagggcgugugcggaaucagaucugcuaccugucuggagaacaucauguggaaacagauuagcaaugaacucaaccauauccugcuugagaaugacaugaaguucacaguuguggucggcgaugccaacgggauucugacccagggcaagaagaugauccgcccccaaccuauggaacacaaauacuccuggaagucuuggggcaaggcuaaaauuaucggggccgacauccagaauacgacauuuauuaucgauggacccgacaccccugagugccccgaugaccagcgggccuggaacauuugggaaguggaggauuauggcuucggcaucuucaccacaaauauuuggcucaagcugagagacagcuacacccagaugugugaucaccgccugauguccgcugcgaucaaagacagcaaggccgugcaugcugauaugggguauuggaucgagucugagaaaaacgagacguggaaacuugcccgggccuccuuuauugaagucaagacaugcaucuggccgagaagccacacccucuggucuaauggaguucuggaguccgaaaugauuaucccuaaaauuuacggcgggcccaucagccaacauaacuaucgcccuggauacuucacacagaccgcuggccccuggcaccuggggaagcucgagcuggacuuugaucuuugcgagggaacaaccgugguggucgacgaacacuguggcaaucggggcccuucucugagaacgaccacagugaccgggaaaaucauucaugaguggugcugucggagcugcacacugcccccgcugcgcuucaagggagaagacggcuguugguacgggauggagaucagaccuguuaaagagaaggaagagaaccuggugcgguccauggucagcgccggaucuggcgaaguggauuccuuuagccuugggcuccugugcguuuccauuaugaucgaggaagugaugagaucucgcuggagccggaagaugcugaugaccggaacgcucgcggucuucuuucugcuuauuaugggccagcugacauggaaugaccucaucagacuguguauuauggugggcgcuaacguuuccgaucgcauggggaugggaaccacauaucuggcccuuauggccaccuucaaaaugagacccauguuugcugugggccuccuguuccggcgccugaccucuagagagguccuccugcuuacaaucgggcugagccucguggccuccguggagcugcccaacucucuggaagaacuuggagacggccuggcgauggggaucaugaugcucaagcugcucacggauuuucaaagccaccagcuguggaccacacuucugucccucaccuucauuaaaacaacccugagccuggacuacgcuuggaagacgaucgccaugguccuuucuauuguuucccuguuuccucucugccugagcacaaccucucagaaaaccacauggcucccggugcugcuuggauccuucggcuguaagccccugaccauguuccugaucacagaaaauaagauuuggggccggaaaagcuggccucucaacgaggggaucauggccgugggaaucgucucuauucugcuuuccagccugcucaagaaugaugugccccuggcuggcccucucaucgccgggggaaugcugauugcuugcuauguuaucuccggcagcucugccgaccuuagccuggaaaaagcggccgagguguccugggaggaagaggcucagcauucuggggccagccacaacauucuggucgaagugcaagaugacggaacgaugaagaucaaagaugaggaacgcgacgauacccucacaauccugcuuaaggcuacccugcucgccguuuccggcguguaccccaugucuauuccugccacacuguuugucugguauuucuggcagaaaaagaagcagagaagcggcgugcucugggacacccccuccccgccugaggucgagcgggcugugcuggacgaugggaucuaccgcauucuucagagaggacugcugggccggucucaaguuggggugggagucuuucaggacggcguguuccauacgauguggcacguuacccgcggggcggugcucauguaucagggaaaaagacuggaacccagcugggccuccgucaagaaagaucuuaucagcuacggcggcggguggcgguuucagggaucuuggaauacaggcgaggaagugcaagugauugcuguugagccugggaagaaccccaaaaauguccagaccacaccgggaaccuucaagacaccugagggcgaagugggggccaucgcccuggacuuuaagcccggaacguccggcagcccuauugugaacagagagggcaaaaucgucgggcucuacggaaauggcgugguuaccacaucugggaccuauguguccgcuaucgcccaggcgaaggcuagccaagaaggaccccugcccgagauugaagaugaggucuucaaaaagcgcaaccucaccaucauggaccugcacccuggcuccgggaaaacacggagauaccuuccggccauugugcgcgaggccaucaagcggaagcugagaacgcugauucucgcucccacccgcguuguggccucugaaauggcggaggcucugaaaggcaugccuauccgguaucagacaaccgccgucaagagcgaacauacaggaagagagaucguggaucuuaugugucacgccaccuuuacgaugcgccugcucucccccguucgggugccuaauuacaacaugauuaucauggacgaagcucauuucacagaucccgccagcauugcugccagaggcuauaucucuacccgggucgggaugggagaggcggccgcuauuuuuaugaccgccacaccuccgggcuccguggaggcuuucccccagagcaaugccgugauccaggacgaagaacgcgauaucccugaaagaucuuggaacagcggguacgacuggauuaccgacuuccccggaaaaacagucugguuuguuccuuccaucaagucuggcagcgauauugccaccgugcuggagcggucccgcgaacccgugauccaacugucuagaaaaacguucgacacagaguaucagaagaccaagaauaacgauugggacuacgucgugacaaccgauauuagcgagaugggggcuaacuuucgggcggacagaguuaucgauccgcgccggugccucaaaccugugauucccaaggacggccccgaaagagucauccuugccggaccuaugcccgugacgguugcuuccgccgcccagcgccggggcagaaucgggcgcaaucagaacaaagagggagaucaauacauuuauaugggccagccucugaauaacgacgaagaucacgcucauuggaccgaggccaagaugcugcucgacaauaucaacacaccggaggggauuauccccgcgcuguucgaaccugagcgggagaaaagcgcugccauugauggagaguacagacuucgcggcgaagccagaaagaccuuuguggagcugaugcggcgcggggaccuccccgucuggcugucuuauaagguggcuuccgagggcuuccaguacagcgacagacgguggugcuuugauggagaacgcaauaaccagguccuggaggaaaauauggacguggagaucuggacaaaagaaggcgagagaaagaaacuccggccuagauggcuugaugcccgcaccuauuccgacccccuggcgcugcgggaguucaaggaauuugccgcugggagacgcucuguuagcggagaucucauccuggagauugaaaaacuuccgcaacaccugacacuccgggcccagaacgcucuggacaaucuggugaugcuccacaacuccgagcagggcgggaaggccuacagacaugcuauggaggaacuuccugauaccaucgagacgcugaugcugcucgcccugauugcggugcuuacaggaggcgucacccuguucuuucucucuggcaaagggcugggaaagaccagcaucggccugcucuguguuauggccuccagcgugcuucuguggauggcuucuguggaaccccacuggauugccgcuuccaucauccuggaguucauucucaugguccugcuuaucccugaacccgaccggcagcgcacaccucaagauaaucagcuggccuaugugguuauugggcuccuguuuaugauccugaccguggccgcuaacgagaugggacuccuugagacaacgaagaaagaccugggcauugggcaugucguggcggaaaaucaccaccaugccaccaugcuggauaucgaccuccaccccgcuagcgccuggacacuguacgccgucgcuaccacaauuaucaccccgaugaugagacauacgaucgagaacaccacagccaacauuucucuuaccgcgaucgccaaucaggcugccauucugaugggacucgauaagggcuggccuaucuccaaaauggacauuggcgugccccugcuggcucucgggugcuacagccaaguuaacccccuuacacugaccgccgcggugcugaugcucgucgcccacuaugcuaucaucggaccuggccugcaggccaaggcuacgcgggaagcccagaaacgcacagcugccgggauuaugaagaauccgaccguggacggaaucguugcgauugaucuugaccccguggucuacgaugccaaguucgagaaacagcugggccaaaucaugcuccugauucuguguacaucucagauccuccuuaugagaaccaccugggcucugugcgaaagcaucacacuggccacggggccucucaccacacugugggagggaucccccggcaaguucuggaacaccacaauugcugugucuauggccaauaucuuucggggcagcuaucuugccggggcgggacuggcuuucucccucaugaaaagccugggcgggggacgcagaggcaccggggcccagggagagacgcugggcgaaaaguggaaacggcagcucaaccaacuuuccaagucugaguuuaauacauacaagcgcagcggcauuauggaaguggacagauccgaggcuaaagaagggcugaagcggggagagaccaccaaacaugccguuucuagaggcacagccaagcugcgcugguucgucgagcggaaccucgugaaaccugaagggaaggugaucgaucugggauguggcagagggggauggagcuauuacugcgcuggccuuaagaaagucaccgagguuaagggcuauacaaaagggggacccggccacgaggaaccuauuccgauggccacguacggguggaaucuggugaagcuccacuccggaaaagacguguuuuucacacccccugaaaagugugauacacugcugugcgacaucggcgagucuagccccaacccuaccauugaggaagggcgcacacuccggguccuuaaaaugguggagcccuggcugagaggaaaucaguuuuguaucaagauccugaacccguacaugccuuccguuguggaaacccucgagcagaugcagcgcaagcauggcggcaugcugguccggaauccccuuagcagaaacucuacgcacgagauguauuggguguccugcgggaccggaaauauuguuagcgcggugaacaugacaucucgcaugcugcucaaucgguucaccauggcccauagaaaacccacauacgaacgcgaugucgaccugggcgcugggacccggcacguggccguggagccugaaaucgcuaaccuggauauuaucggacaaagaauugagaacaucaagaucggccacaaauccacauggcauuaugacgaagacaaucccuacaagaccugggccuaucacgggagcuacgaggucaaaccuucuggauccgcgagcuccaugguuaacggcguggugcgccuccugacgaagccgugggaugucauucccauggugacacagaucgccaugaccgacaccacaccuuuuggccagcaaagaguuuucaaggagaaaguggauacgcggacaccccgcccuaagagagggacagcucagauuauggaagucaccgccaaauggauguggggauuucuuuuccggaauagacccccgcggaucuguacacgcgacgaguuugcuagaaaggugcggagcucuaccgccaacggcgcuguuuucguggaugaaaaucaguggaacagcgccaaagaggcggucgaagacgagcgcuucugggaucuggugcauagagagcgggaacuccacaagcaggggaagugcgccacaugcguuuauaauaugaugggaaaacgcgagaagaaacugggcgaauuugggaaggcuaaaggcuccagagccauuugguacauguggcuuggagcucgguuccuggaguuugaagcccucggcuucaugaacgaggaccauugguuuucucgcgagaauagccuguccgggguggaaggagagggccugcacaagcucggguacauccugagagauaucucuaagauuccuggaggcaacauguaugccgacgauaccgcggggugggacacgcggaucaccgaagaugacagcuccaaugaggcuaaaauuaucgagcuuaugcgccccgaacacgcccugcucgccacaucuauuuucaagcugaccuuucaaaucagcgucgugagaguccagcggccugcuaaauccggcacagugauggaguguaucagccgcagagaccagaagcggucuggacagguuggcaccuacgggcuuaacacguucacaaauauggaagugcaacugauuagacagauggaguccgaaggaaucuuuagccccucugagauggagaacuccaaucucgccgaacgcguccuggauuggcuggagaaacauggcguggaacggcucaagagaauggcuauuagcggggacgauugcgugguuaaaccuaccgacgaucgcuucgccacagcgcugaccgcccuuaacgacaugggaaaggugcggaaggauaucccccagugggagccguccaaaggcuggaacgacuggcagcaagucccuuuuuguucucaccauuuccaccagcugauuaugaaggaugggagagaaaucgugguucccugccgcaaucaggacgagcucgugggccgggcuagagucagccagggagccggcuggucccugcgcgagacggcuugucuugggaaaagcuaugcccaaauguggcagcugauguacuuucaccggagagaucuccgccuggcggccaacgcuauuugcucugccgugcccgucgacugggugccuaccucccggacaaccuggagcauccaugcucaccaucaguggaugacaaccgaagacaugcugucuguuuggaauagaguguggaucgaggaaaacccguggauggaggauaagacacacgucagcuccugggaagacgugcccuaucucggaaaacgggaggaucaaugguguggcucucugauugggcuuaccgccagagcuacgugggccacaaauauccagguugcgauuaaccaggugcgccggcugaucggaaaugagaacuaccucgacuauaugaccagcaugaagagauucaagaaugaauccgauccugagggcgcccugugguga

SEQ ID NO: 18524 - RNA, 9879 nt, Artificial Sequence
  derived and/or modified CDS sequence (opt5) from DENV-1__GU131887__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagagcaggacgcuaacuucgugugccggcgcacauuuguggauagaggcuggggcaauggguguggacucuucggcaaagggucucugaucaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagauccgguacgagggcacagacgcgccgugcaagaucccuuucuccacccaagaugaaagagggguuacacagaacggacgccugauuacggcuaaucccaucgugaccgacaaagagaagccugucaacauugaagccgagccccccuuuggcgagagcuauaucgugauuggggccggagaaaaagcucuuaagcucucuugguucaaaaagggcagcuccaucgggaagauguuugaggccacagcucggggcgccagacgcauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucucgguccacaagcuucucuaugaccuguauugccgugggccugguuacacuguaccuuggggugaugguccaggcugauuccggaugcgugaucaacuggaaaggcagagaacucaagugugggagcggaauuuuuguuaccaaugaggugcacacauggaccgaacaauauaaauuccaggccgacuccccuaagcgccugucugcggccaucggcaaggcuugggaggagggggucugcggcauccggagcgccacgagacuggaaaacauuauguggaaacagaucuccaacgagcucaaucauauucugcuugaaaacgacaugaaguuuacagugguugugggagaugucgcuggcauccuggcccaggggaaaaagaugauucgcccgcaacccauggaguacaaauauucuuggcggagcuggggaaaggccaaaaucaucggcgcugacgugcagaauaccaccuucauuaucgaugggccuaacacacccgaauguccugacgaucagagagcguggaauauuugggagguggaggacuacggauuuggcaucuucaccacgaacauuuggcucaagcugcgcgauuccuauacacaggucugcgaccaccggcugaugagcgccgcuaucaaggauucuaaagccguucacgccgacaugggcuacuggaucgaauccgagaagaaugaaaccuggaaacuugcuagagccagcuucauugaggugaagacauguaucuggcccaaaucucauacccucugguccaacggggugcuggaaagcgagaugauuaucccgaagauuuauggaggcccuaucucucaacacaauuaccggcccggguacuuuacacagaccgcgggaccuuggcaucugggcaagcucgagcuggauuucgaccuuugcgaagggacgaccgucgugguugaugagcacugcggaaaccgcggccccagccugagaacaaccacagugaccggcaaaaucauucacgaaugguguugccgguccuguacgcucccuccccugagauuucgcggggaggacggaugcugguauggcauggagauccggccggucaaggaaaaagaggaaaaucuggugaagagcaugguuucugcuggguccggagagguggacagcuucucccuuggccuccuguguauuucuaucaugauugaagaggucaugagaagccgcugguccagaaaaaugcugaugacagggacccucgccguguuucugcuucugaucaugggacagcucacauggaacgaucugauucggcugugcaucaugguuggcgccaaugcuucugaccgcaugggcauggggaccaccuaccuugcccugauggcgacauucaagaugagaccuauguuugcugugggacuccuguuccggcgccucacgagcagagagguccugcuucugaccaucggccucucccugguggccucuguggaacugcccaacagccuugaggaacugggggauggacucgccaugggcauuaugauccugaagcuccugacagacuuucaaucccaucagcuuugggcuacccugcucagccugacauucauuaaaaccacguuuucucugcacuaugccuggaagacaauggcuaugguccuuuccaucguuagccuguucccccucugucugucuaccaccucccagaaaacaaccuggcucccugugcugcuugggagccugggaugcaagccgcugacaauguuucucauugccgagaauaaaaucuggggccggcgcucuuggccccugaacgaaggcaucauggcgguggggauugucuccauccuucugagcucccuccugaagaacgaugugccucucgccggaccccugauugcuggcgggaugcuuaucgccuguuacguuauuagcggaucuagcgcugaccugucccuggagaaggccgccgaggugucuugggaagaggaagcugagcauagcggcgcgucccacaauauccucgucgaagugcaggaugacgggacgaugaaaaucaaggaugaggagagagacgauacccugacaauucuucugaaagccacccuccuggcuguuucuggaguguauccucucagcauccccgccacacuguucgucugguacuucuggcaaaagaaaaagcagcgguccggcgugcuuugggacaccccuucucccccggaagucgagcgcgccgugcuggaugacggcauuuauagaaucaugcagcgggggcugcucggaagaagccagguuggcgugggggucuuucaagaaaacguguuccauacgauguggcacguuacccgcggagcugugcugauguaccagggcaaacggcuugagccuuccugggccagcgucaagaaggaccugauuucuuacgggggaggcuggagacuccagggcuccuggaauacaggggaggaagugcaggugaucgcgguugagcccggaaaaaacccuaagaauguccaaaccgcucccggcacauuuaaaaccccggaaggggaggugggagccauugcccuggauuucaagccuggcacaagcgggucucccaucgugaaccgcgaaggaaaaaucgucggccucuauggcaauggggugguuacgaccuccggaacauacgugagcgcuauugcccaggcgaaggcuucccaggagggcccucugcccgagaucgaagacgaggucuuucggaagagaaaccuuaccauuauggaucugcaccccgggucuggaaaaacccgccgguaucugccugccaucgugagagaagccauuaagcgcaaacuccggacacugauccuugcuccgacgagaguuguggccagcgagauggcugaagcccugaagggcaugcccauccgguaccaaaccacagcggucaaauccgagcauaccgggaaggagauuguggaccucaugugccacgccacauucaccaugcgccugcugagcccuguuagagugcccaauuauaacaugaucauuauggaugaagcucauuuuacggacccuucuuccaucgccgcucggggcuacauuagcacacgcgucggaaugggcgaggccgccgcuaucuucaugaccgcgacccccccugggucuguggaagccuuuccgcagagcaaugcugugauccaggaugaggaaagagacauucccgagcgguccuggaacucuggauaugaguggaucacagauuucccuggcaagaccgucugguuuguucccagcauuaaauccgggaaugacaucgccaacugucucagaaagaauggaaaacgcgugauucagcuuucucggaagacauucgauaccgaauaccaaaaaacgaagaacaacgacugggacuacguggucacaaccgauaucagcgagaugggcgccaauuucagagcugaccgcgugauugauccucggagaugccugaagcccguuauccugaaagacgggccggaacgcgugauccucgccggcccuaugcccgucacaguggcguccgcugcccagcggagaggacgcauuggcagaaaccacaauaaggagggggaucaguauaucuacaugggacagccccugaacaaugacgaggaucaugcccacuggaccgaagcuaaaaugcuucuggacaacauuaauacgccugagggcaucauucccgcccucuuugaaccugagcgggaaaagagcgcggccaucgauggggaguaucgccugagaggagaggcucggaaaaccuucguugaacugaugcgcagaggcgaccucccgguguggcuuucuuacaaggucgccuccgagggguuucaauauagcgaucggagauggugcuucgacggcgaacgcaacaaucaggugcuggaggaaaacauggaugucgagaucuggacaaaggagggagaacggaaaaagcugagaccccgcuggcucgacgcucggaccuacuccgacccucuggcccuuagagaguuuaaagaauucgcugccggccggcgcucugugagcggggaucugauucucgagaucggaaagcugccccagcaccugacacagagagcgcaaaaugcccucgacaaccuuguuaugcugcauaauuccgaacagggcgggcgggcuuaucgccacgccauggaggagcugccugauaccauugaaacacucaugcugcuugcucugaucgccgcccucaccggaggcgugacgcuguuuuuccugucuggcagagggcucggaaaaacaagcauuggccuucugugugugauggcuuccagcguccugcucuggauggcgucuguugagccccauuggaucgccgcuuccaucauucuggaauuuuuccuuauggugcugcucaucccggagccugaccggcagcgcaccccccaggauaaccaacuggccuacguggucauugggcugcucuuuaugauccuuaccguggccgcuaaugagaugggacugcuggaaacaaccaagaaagaccucggcauugggcacguugccgugggaaaccaccaucacgcggccaugcuggaugucgaccuucauccugcuagcgccuggacacuguacgcuguggccacgaccaucauuacacccaugaugagacacaccaucgagaacacaaccgcgaauaucucucucacggccauugcuaaccaggccgcuauccugaugggccuggauaagggcuggccuauuuccaagauggacaucggggucccccuccuugcccugggaugcuauagccaggugaauccgcugacccucacagcugccguucugaugcuuguggcgcauuacgccauuaucggcccugggcugcaagcuaaagccacccgggaagcucagaagcgcacagccgccggaaucaugaaaaaccccaccgucgauggcauuguggcgaucgaccucgaucccguuguguaugacgcuaaguucgagaaacagcuggggcagauuaugcugcucauccuuuguacgucucaaauucugcugaugagaacaaccugggcccucugcgaaagcaucacacuggcuaccggaccucuuaccacacugugggagggcuccccgggcaaguuuuggaauacgaccaucgccgucucuauggccaacauuuuccgggggagcuaccucgcuggagccggccuggcguucucccugaugaagagccucgggggaggcagacgcgggacaggagcccagggcgagacccuuggcgaaaaauggaagcggcagcugaaucagcuguccaaaucugaguuuaacacauauaagagaagcgggaucauggaaguggaccgcuccgaggcuaaagaaggacucaagcggggcgagauuaccaagcacgccgugucuagagggacggcuaaacugcgcugguucguugagcggaaucuugucaagcccgaaggaaaagugaucgaucugggcugugggagaggaggcuggagcuacuauugcgccggccucaagaaagugacagaggucaagggguacaccaagggaggcccugggcacgaagagcccauuccuauggcgaccuacggauggaaccugguuaaacugcauuccggcaaggacguguuuuucgugcccccugaaaaaugugauacacuccuuugcgacaucggggagucuagcccgaaucccaccauugaggaaggacgcacacugcggguccugaagaugguggagccuuggcucagaggcaaccaauuuuguaucaaaauccugaaucccuauaugccuuccguuguggaaacgcuugagcagaugcagcgcaagcacggcgggaugcugguccggaacccccucagcagaaauucuacccaugagauguacuggguguccugcggaacaggcaacauuguuagcgccgugaauaugaccucucgcaugcugcugaacagauucacaauggcucaccggaaaccgaccuaugaacgcgaugucgaccucggggccggaacgagacacguggcuguggagccugaagucgccaaccuggauaucauuggccagcggaucgagaauauuaagcaugaacacaaguccaccuggcauuacgacgaggauaaccccuauaaaacaugggcuuaccacgggagcuaugagguuaagcccucuggauccgccagcuccauggugaauggcguggucaaacuucugaccaagccuugggacgugauccccaugguuacacaaaucgcgaugaccgauacaaccccuuuuggccagcagagaguguucaaagaaaaggucgacacgcggacaccgaaggccaaacgcgggaccgcucaaauuauggaggugaccgccaaguggcucuggggauuucugagcagaaacaaaaagccccggaucuguacacgcgaagaguucacgagaaaaguucggucuaaugcugccauuggcgccguguuugucgacgaaaaccaguggaauagcgcgaaggaggcuguggaggaugaacgcuucugggaccuuguucauagagagcgggaacugcacaagcaggggaaaugcgccaccugcguguacaacaugaugggaaagcgcgagaaaaagcucggcgaauuugggaaagccaagggcuccagagcuaucugguacauguggcugggagcccgguuccuggaguucgaggcucucggcuuuaugaaugaagaucacugguucucucgcgagaacagccuguccggggucgaaggagagggccuucauaagcugggguauauucucagagacaucucuaaaaucccuggaggcaauauguacgccgaugacacagcggggugggauacccggauuacagaggacgaucugcagaacgaagcccgcaucaccgacauuauggagcccgaacacgcucuucuggccaagagcaucuuuaaacucacauaucaaaauaagguggucagagugcagcggccugcuaaaaacggcaccguuauggaugugauuuccagacgcgaccagcggggaucuggccaggucgggacguacggacugaauaccuucacaaacauggaggcccaacugaucagacagauggaaagcgagggcaucuuuucccccagcgagcucgaaaccccgaaccuggcggagcgcgugcuugauuggcuggaaaaguaugggguggagcggcucaaaagaauggccauuucuggagacgacuguguugugaagccuaucgaugaccgcuucgcuacagcccugaccgcucuuaaugauaugggcaagguccggaaagacauuccccagugggaaccuuccaagggguggaacgauuggcagcaagugcccuuuugcagccaucacuuccaccagcugaucaugaaagacggcagagagauuguugugccuugucgcaaucaggaugagcucgucggacgggccagagugucucagggcgcuggguggucccugcgcgaaacggccugccugggaaagagcuacgcgcaaauguggcagcucauguauuuucaucggagagaccugcggcuugccgcuaacgccaucuguuccgccguccccguggauuggauuccgacaucuagaaccacauggagcauccacgcucaucaccaguggaugaccacggaggacaugcuguccguuuggaaucgcguguggaucgaagagaacccuuggauggaagauaaaacccauauuagcucuuggggcgacguccccuaccucgggaagcgggaggaccaauggugcggaucccugaucggccuuacagccagagcgaccugggcuacaaauauucagguggccaucaaccagguucgcagacugauugggaaugagaacuaccucgauuauaugaccagcaugaagcgguucaaaaaugaaucugaccccgagggcgcccugugguga

SEQ ID NO: 18525 - RNA, 9879 nt, Artificial Sequence
  derived and/or modified CDS sequence (opt5) from DENV-1__GU131888__SS-prME
agcgugaccaugcugcugaugcugaugcccacagcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagucugccuggaaacagauucagcggguugaaacaugggcucugcgccaccccggcuucaccgugaucgcccuuuuucuggcgcaugccauuggcacaagcaucacccagaaggggaucauuuucauccuccugaugcuugucaccccuuccauggcuaugagaugcgugggaauuggcagccgggauuuuguugaggggcugucuggagccacauggguggacgucgugcucgagcacggcuccugugugacgaccauggcuaaggauaaacccacacuggacaucgaacugcucaagaccgaggucacaaacccugccauucugcgcaaacuuugcaucgaagcgaagauuagcaauaccacgacagauucuagauguccgacccaaggggaggccacccugguugaagaacaagacgcuaacuucgugugccggcgcacauuuguggauagaggauggggcaauggcugugggcuguucggaaaaggcucccugauuaccugcgccaaguuuaagugcgucacaaaacuugaggggaagaucgugcaguacgaaaaccugaaauauagcguuauugugacgguccacaccggagaccagcaucaagugggcaaugagucuacagaacacgggaccacagcuaccaucacgccccaggccccuaccacagagauucagcucaccgacuacggagcccugacacuggauuguagcccccggaccggccucgacuucaacgaaaugguucugcuuacgaugaaggagaaaagcuggcuggugcauaagcagugguuucucgaucugccucuucccuggacauccggcgcuucuaccagccaagagacauggaaucgccaggaccugcucgucaccuucaaaaccgcgcacgccaagaagcaggaaguggucgugcuggggucccaagagggagcuaugcacacagcccugacgggcgccaccgaaauccagacaagcgggaccacaaccauuuuugcuggacaucucaaaugcagacugaagauggauaaacuuacgcugaagggcaugucuuauguuauguguacaggguccuucaaacucgagaaggaaguggccgagacccagcacggcaccguccuggugcagaucaaguacgagggaacagacgcgccgugcaaaaucccuuuccugacccaagaugaaaagggcguuacacagaacgggcggcuuauuacggcuaaucccaucgugaccgacaaagagaagccugucaacauugaagccgagccgcccuuuggagagagcuauaucgugauuggcgccggggaaaaagcucucaagcugucuugguucaagaaaggaagcuccaucggcaagauguuugaggccacagcuagaggggcccgccggauggcgauccugggcgauaccggaugggacuucggcucuauugggggaguguuuacaagcguuggcaaacucguccaucagaucuucgggaccgccuacggagugcuguuuuccggcgugagcuggacgaugaagauugggaucggcguccuucugaccuggcucggacucaauucuagauccacaagccugucuaugaccuguauugcugugggccuuguuacacucuaccugggggugaugguccaggccgauuccggaugcgugaucaacuggaaaggccgcgaacugaagugugggagcggaauuuucguuaccaaugaggugcacacauggaccgaacaauauaaguuucaggcugacuccccuaaacggcucucugccgcgaucggcaaggccugggaggagggggucugcggcaucagaagcgcuacgcgccuggaaaacauuauguggaaacagaucuccaacgagcuuaaucauauucugcucgaaaacgacaugaaguucacagugguugugggagaugucgccggcauccuggcucaggggaaaaagaugauucggccgcaacccauggaguacaaauauucuuggaaaagcuggggaaaggccaagaucaucggcgccgacgugcagaauaccaccuuuauuaucgaugggccuaacacacccgaauguccugacgaucagagagcuuggaauauuugggagguggaggacuacggauucggcaucuuuaccacgaacauuuggcugaaacuucgcgauuccuauacacaggucugcgaccaccggcucaugagcgcggccaucaaagauucuaaggcuguucacgccgacaugggcuacuggaucgaauccgagaaaaaugaaaccuggaagcuggccagagcuagcuucauugaggugaagacauguaucuggcccaaaucucauacccugugguccaacggggugcucgaaagcgagaugauuaucccgaagauuuauggaggcccuaucucucaacacaauuaccgccccggguacuucacacagaccgccggaccuuggcaucugggcaaacuugagcuggauuuugaccucugcgaagggacgaccgucgugguugaugagcacugcggaaaccggggccccagccugagaacaaccacagugaccggcaagaucauucacgaaugguguugccgguccuguacgcugccuccccuucgcuucagaggggaggacggaugcugguauggcauggagauccggccggucaaagaaaaggaggaaaaucucgugaaguccaugguuucugcgggguccggagagguggacagcuuuucccugggccugcucuguauuucuaucaugauugaagaggucaugagaagccgcuggucccggaaaaugcugaugacagggacccuugcuguguuccugcuccugaucaugggacagcugacauggaacgaucuuauuagacugugcaucaugguuggcgccaaugccucugaccgcaugggcauggggaccaccuaccucgcucugauggccacauuuaagaugagaccuauguucgcggugggacuccuguuucggcgccuuacgagcagagagguccugcuccugaccaucggccugucccuuguggcuucuguggaacugcccaacagccucgaggaacugggggauggacucgccaugggcauuaugauccugaaacuucugacagacuuccaaucccaucagcucugggccacccugcugagccuuacauuuauuaagaccacguucucucugcacuaugcuuggaaaacaauggccaugguccucuccaucguuagccuguuuccccucugucugucuaccaccucccagaagacaaccuggcuuccugugcugcuggggagccucggaugcaagccgcugacaauguuccuuauugcugagaauaaaaucuggggccggcgcucuuggccccugaacgaaggcaucauggccguggggauugucuccauccuccugagcucccuccugaagaacgaugugccucuugcgggaccccugauugccggcgggaugcugaucgcuuguuacguuauuagcggaucuagcgccgaccucucccuggagaaagcugccgaggugucuugggaagaggaagccgagcauagcggcgcuucccacaauauccuugucgaagugcaggaugacgggccuaugaagaucaaagaugaggagagagacgauacgcugaccauucuccugaaggcgacacuccuggccguuucuggaguguauccccuuagcaucccugcuacccuguuugucugguacuucuggcagaagaagaagcagcgguccggcgugcugugggacacacccucuccgccugaagucgagcgcgccgugcucgaugacggcauuuauagaaucaugcagcgggggcugcuuggacgcagccagguuggcgugggggucuuccaagaaaacguguuucauaccauguggcacguuacgagaggagccgugcugauguaccagggcaaacggcucgagcccuccugggcuagcgucaagaaagaccugauuucuuacgggggaggcuggagacuccagggcuccuggaauaccggggaggaagugcaagugaucgccguugagccuggaaagaaccccaaaaauguccaaacagcgccgggcaccuucaagacaccugaaggggaggugggagcuauugcccuggauuuuaagcccggcaccagcgggucuccuaucgugaaccgcgaaggaaaaaucgucggccuuuauggcaauggggugguuacaacguccggaaccuacgugagcgccauugcucaggccaaggcgucccaggagggcccccugcccgagaucgaagacgaggucuuccggaaaagaaaccugacaauuauggaucuccacccugggucuggaaagacccgccgguaucugccggcuaucgugagagaagccauuaaacgcaaacuucggacccugauccucgcccccacaagaguuguggcuagcgagauggccgaagcucugaagggcaugccuauccgcuaccaaacgaccgccgucaaauccgagcauacagggaaggagauuguggaccugaugugccacgcgaccuuuacaaugcggcuccuuagccccguuagagugccuaauuauaacaugaucauuauggaugaagcccauuucaccgaccccucuuccaucgcugcccggggcuacauuagcacgcgcgucggaaugggcgaggcugccgccaucuuuaugacagcuaccccuccggggucuguggaagcguucccccagagcaaugcccugauccaggaugaggaaagagacauuccugagcgguccuggaacucuggauaugaguggaucaccgauuuucccggcaaaacagugugguucgucccuagcauuaaguccgggaaugacaucgcuaacugucugcgcaaaaauggaaagagaguuauucagcucucucggaagaccuuugauacagaauaccagaagaccaagaacaacgacugggacuacguggugacgacagauaucagcgagaugggcgccaauuucagagccgaccgcgucauugauccccggagaugccugaaaccggugauccuuaaggacgggccugaacgcguuauccuggcuggccccaugcccgugaccgucgccuccgcggcucagcggagaggacgcauuggccggaaccacaauaaagagggggaucaguauaucuacaugggacagccucucaacaaugacgaggaucaugcccacuggacagaagccaagaugcugcuggacaacauuaauacccccgagggcaucauuccugcucucuucgaaccggagagagaaaagagcgccgcgaucgauggggaguaucgccuuagaggagaggcccggaaaacguuuguggaacugaugcgcagaggcgaccugcccguuuggcucucuuacaagguggcuuccgagggguuccaauauagcgaucggcgcuggugcuuugacggcgaaagaaacaaucagguccuggaggaaaacauggauguggagaucuggaccaaagagggagaacggaagaaacuuagaccucgcuggcuggacgcccggacauacuccgacccccucgcucugagagaguucaaggaauuugccgcuggccgccggucugucagcggggaucugauucucgagaucggaaaacuuccucagcaccugacccagagagcccaaaaugcgcuggacaaccucgugaugcugcauaauuccgaacagggcgggcgggccuaucgccacgcuauggaggagcuucccgauacaauugaaacccugaugcuccuggcccugaucgcuguucucacaggaggcgugacccuuuucuuucugucuggcagagggcugggaaagacgagcauuggccuccugugugugauggccuccagcguccuucuguggauggccucuguugagccgcauuggaucgcugcguccaucauucucgaguucuuucugauggugcugcucaucccugagcccgaccggcagcgcacaccucaggauaaccaacuugccuacguggucauugggcugcuguucaugauccucaccguggcugccaaugagaugggacugcuugaaaccacaaagaaagaccugggcauugggcacguugccgugggaaaccaccaucacgcugccaugcucgaugucgaccugcaucccgcgagcgccuggacccuguacgcuguggccacaacgaucauuaccccuaugaugagacacacaaucgagaacaccacagcuaauaucucucucaccgccauugcgaaccaggccgcuauccuuaugggccuggauaagggcuggcccauuuccaaaauggacaucggggucccgcugcucgcccugggaugcuauagccaggugaauccucuuacgcugaccgcugccguucucaugcugguggcucauuacgccauuaucggccccgggcugcaagcgaaggccacacgggaagcucagaaacgcaccgccgcuggaaucaugaagaaccccacagucgauggcauuguggccaucgaccucgauccuguuguguaugacgccaaguuugagaaacagcuugggcagauuaugcugcugauccucuguaccucucaaauucugcuuaugagaacgacaugggcgcugugcgaaagcaucacccucgcuacaggaccgcugaccacccugugggagggcucccccggcaaguucuggaauacaacgaucgccgucucuauggcuaacauuuuucgggggagcuaccucgccggagccggccuugcuuucucccugaugaaaagccucgggggaggccgcagagggaccggagcccagggcgagacacucggcgaaaaguggaaacggcagcugaaucagcuuuccaagucugaguucaacaccuauaagagaagcgggaucauggaaguggaccgcuccgaggcgaaagaaggacugaagcggggcgagacaaccaaacacgccgugucuagagggacggcuaagcuccgcugguuuguugagcggaaucuggucaaaccugaaggaaaggugauugaucugggcugugggagaggaggcuggagcuacuauugcgccggccucaagaaagugacagaggucaagggguacaccaaaggaggccccgggcacgaagaaccuauccccauggcuaccuacggauggaaccuuguuaagcugcauuccggcaaagacguguucuuuauuccuccggaaaagugugauacacugcucugcgacaucggggagucuagccccaauccuaccauugaggaaggacgcacacugcgggugcuuaaaauggucgagcccuggcugagaggcaaccaauucuguaucaagauccucaauccuuauaugcccuccgugguugaaacgcuggagcagaugcagcgcaagcacggcgggaugcuggugcggaacccgcucagcagaaauucuacccaugagauguacugggucuccugcggaacaggcaacauugugagcgccguuaauaugaccucucgcaugcugcuuaaccgguuuacaauggcgcacagaaaaccuaccuaugaacgcgauguggaccugggggccggaacgagacacgucgcuguggagcccgaaguggccaaccucgauaucauuggccagcggaucgagaauauuaagcaugaacacaaauccaccuggcauuacgacgaggauaaccccuauaagacaugggcuuaccacgggagcuaugaggucaaaccuucuggauccgccagcuccaugguuaauggcguggugaagcugcuuaccaagcccugggacgucaucccuauggugacacaaaucgcuaugaccgauacaaccccguucggccagcagcgcguuuuuaaagaaaagguggacacgagaacacccaaagccaagcgggggaccgcgcaaauuauggaggucaccgccaaauggcuguggggauuccucagcagaaacaagaagccucggaucuguacacgcgaagaguuuacgagaaaagugcggucuaaugcugccauuggcgcuguuuucguggacgaaaaccaguggaauagcgccaaggaggccgucgaggaugaacgcuuuugggaccuggugcauagagagcgggaacugcacaaacaggggaagugcgcgaccugcguuuacaacaugaugggaaaacgcgagaagaagcucggcgaguucgggaaagcuaagggcuccagagccaucugguacauguggcugggagcccgguuucuugaguucgaggcucugggcuucaugaaugaagaucacugguuuucucgcgagaacagccucuccgggguggaaggagagggccugcauaaacuuggguauauucugagagacaucucuaagauccccggaggcaauauguacgccgaugacacagcugggugggauacccggauuacagaggacgaucuccagaacgaagcccgcaucaccgacauuauggagccugaacacgcgcugcuggccaaaagcaucuucaagcucacauaucaaaauaaagucgugagaguccagcggcccgcuaagaacggcaccgugauggauguuauuucccgcagagaccagcggggaucuggccagguggggacguacggacugaauaccuuuacaaacauggaggcccaacuuaucagacagauggaaagcgagggcaucuucuccccgagcgagcuggaaaccccuaaccucgcugagcgcguccuggauuggcuugaaaaguaugggguggagcggcugaaaagaauggccauuucuggagacgacugugugguuaagcccaucgaugaccgcuuugcgacagcccucaccgcucugaaugauaugggcaaagugcggaaggacauuccucagugggaacccuccaaaggguggaacgauuggcagcaagucccuuucugcagccaucacuuucaccagcugaucaugaaggacggcagagagauugugguucccugucgcaaucaggaugagcucgugggacgggccagagucucucagggcgcuggguggucccugcgcgaaacggccugccuuggaaagagcuacgcucaaauguggcagcugauguauuuccaucggagagaccuccgccuggccgcgaacgccaucuguuccgcugugccggucgauuggauuccuacaucucggaccacauggagcauccacgcccaucaccaguggaugaccacggaggacaugcuuuccguguggaauagaguuuggaucgaagagaaccccuggauggaagauaaaacccauauuagcucuuggggcgacgugcccuaccuggggaagcgggaggaccaauggugcggaucccucaucggccugacagccagagcuaccugggccacaaauauucaggucgcgaucaaccaggugcgccggcugauugggaaugagaacuaccucgauuauaugaccagcaugaaaagauuuaagaaugaaucugacccugagggcgcucugugguga

SEQ ID NO: 18526 - RNA, 9879 nt, Artificial Sequence
  derived and/or modified CDS sequence (opt5) from DENV-1__GU131892__SS-prME
agcgugaccaugcugcucaugcugaugcccacagcccuugcuuuccaccugacgaccagaggcggggagccucauaugaucgucuccaagcaggaacggggaaaaucucuccuguuuaagaccagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaaguucacagugguugugggagaugucgcuggcauccucgugcaggggaaaaagaugauucggccgcaacccauggaguacaaauauucuuggaaaagcuggggaaaggccaagaucaucggcgccgacgugcagaauaccaccuuuauuaucgaugggccuaacacacccgaauguccugacgaucagagagcuuggaauauuugggaggucgaggacuacggauucggcaucuuuaccacgaacauuuggcugaagcugcgcgauuccuauacacagguuugcgaccaccggcuuaugagcgcggccaucaaagauucuaaggcugugcacgccgacaugggcuacuggaucgaauccgagaaaaaugaaaccuggaagcucgccagagcuagcuucauugaggugaagacauguaucuggcccaaaucucauacccugugguccaacgggguccuggaaagcgagaugauuaucccgaagauuuauggaggcccuaucucucaacacaauuaccgccccggguacuucacacagaccgccggaccuuggcaucucggcaaacuggagcuugauuuugaccugugcgaagggacgaccgugguuguggaugagcacugcggaaaccggggccccagccucagaacaaccacagucaccggcaagaucauucacgaaugguguugccgguccuguacgcugccuccccugcgcuucagaggggaggacggaugcugguauggcauggagauccggccggugaaagaaaaggaggaaaaucuuguuaagagcauggugucugcgggguccggagaggucgacagcuuuucccucggccugcuguguauuucuaucaugauugaagaggugaugagaagccgcuggucccggaaaaugcucaugacagggacccuggcuguuuuccuucugcucaucaugggacagcugacauggaacgaucugauuagacuuugcaucauggugggcgccaaugccucugaccgcaugggcauggggaccaccuaccuggcucucauggccacauuuaagaugagaccuauguucgcggucggacugcucuuucggcgccugacgagcagagaggugcuucugcucaccaucggccugucccugguggcuucugucgaacuucccaacagccuggaggaacucggggauggacuggccaugggcauuaugauccucaaacugcuuacagacuuccaaucccaucagcugugggccacccuccugagccugacauuuauuaagaccacguucucucuucacuaugcuuggaaaacaauggccaugguucuguccaucgugagccucuuuccccugugucucucuaccaccucccagaagacaaccuggcugccugugcuucuggggagccugggaugcaagccgcucacaauguuccugauugcugagaauaaaaucuggggccggcgcucuuggccccuuaacgaaggcaucauggccgucgggauuguguccauccugcucagcucccugcucaagaacgauguuccucuggcgggaccccuuauugccggcgggaugcugaucgcuuguuacgugauuagcggaucuagcgccgaccugucccucgagaaagcugccgaggucucuugggaagaggaagccgagcauagcggcgcuucccacaauauccugguggaaguucaggaugacgggacgaugaagaucaaagaugaggagagagacgauacccuuacaauucugcucaaggcgacccugcucgccgugucuggagucuauccucugagcauccccgcuacacuuuuugugugguacuucuggcagaagaagaagcagcgguccggcguccugugggacaccccuucucccccggaaguggagcgcgccguucuggaugacggcauuuauagaaucaugcagcgggggcuccugggacgcagccaggugggcgucgggguguuccaagaaaacguuuuucauacgauguggcacgugaccagaggagccguccuuauguaccagggcaaacggcuggagccuuccugggcuagcgugaagaaagaccucauuucuuacgggggaggcuggagacugcagggcuccuggaauacaggggaggaagugcagguuaucgccgucgagcccggaaagaacccuaaaaaugugcaaaccgcgcccggcacauucaagaccccggaaggggaggugggagcuauugcccucgauuuuaagccuggcacaagcgggucucccaucgucaaccgcgaaggaaaaaucgugggccuguauggcaaugggguugugacgaccuccggaacauacgucagcgccauugcucaggccaaggcgucccaggagggcccucuucccgagaucgaagacgagguguuccggaaaagaaaccugaccauuauggaucugcaccccgggucuggaaagacccgccgguaucucccugcuaucguuagagaagccauuaaacgcaagcugcggacacuuauccuggccccgacgagaguggucgcuagcgagauggccgaagcucucaagggcaugcccauccgcuaccaaaccacagccgugaaauccgagcauaccgggaaggagauuguugaccugaugugccacgcgacauuuaccaugcggcugcucagcccugugagaguccccaauuauaacaugaucauuauggaugaagcccauuucacggacccuucuuccaucgcugcccggggcuacauuagcacacgcgugggaaugggcgaggcugccgccaucuuuaugaccgcuacacccccugggucuguggaagcguucccgcagagcaaugccgucauccaggaugaggaaagagacauucccgagcgguccuggaacucuggauaugaguggaucacagauuuuccuggcaaaaccguuugguucgugcccagcauuaaguccgggaaugacaucgcuaacugucuucgcaaaaauggaaagagagugauucagcugucucggaagacauuugauaccgaauaccagaaaacgaagaacaacgacugggacuacgucgugacaaccgauaucagcgagaugggcgccaauuucagagccgaccgcguuauugauccucggagaugccugaaacccgugauccucaaggacgggccggaacgcgucauccuggcuggcccuaugcccgugacaguugccuccgcggcucagcggagaggacgcauuggccggaaccacaauaaagagggggaucaguauaucuacaugggacagccccuuaacaaugacgaggaucaugcccacuggaccgaagccaagaugcugcucgacaacauuaauacgccugagggcaucauucccgcucuguucgaaccugagagagaaaagagcgccgcgaucgauggggaguaucgccugagaggagaggcccggaaaaccuuuguggaacucaugcgcagaggcgaccuuccggucuggcugucuuacaagguggcuuccgagggguuccaauauagcgaucggcgcuggugcuuugacggcgaaagaaacaaucagguccuggaggaaaacauggauguggagaucuggacaaaagagggagaacggaagaaacucagaccccgcuggcuggacgcccggaccuacuccgacccucuugcucugagagaguucaaggaauuugccgcuggccgccggucuguuagcggggaucucauucuggagaucggaaaacugccccagcaccucacacagagagcccaaaaugcgcuugacaaccuggugaugcugcauaauuccgaacagggcgggcgggccuaucgccacgcuauggaggagcucccugauaccauugaaacacugaugcuucuggcccucaucgcugugcugaccggaggcgucacgcuguucuuucucucuggcagagggcuuggaaagacaagcauuggccugcuguguguuauggccuccagcgugcuccuguggauggccucuguggagccccauuggaucgcugcguccaucauucuugaguucuuucugaugguccuccugaucccggagccugaccggcagcgcacaccccaagauaaccaacuggccuacgugguuauugggcuccuuuucaugauccugaccguggcugccaaugagaugggacugcucgaaaccaccaagaaagaccugggcauugggcacgucgccgugggaaaccaccaucacgcugccaugcuugaugucgaccugcauccugcgagcgccuggacacucuacgcuguggccacgaccaucauuacacccaugaugagacacaccaucgagaacacaaccgcuaauaucucucugacggccauugcgaaccaggccgcuauccugaugggccucgauaagggcuggccuauuuccaaaauggacaucgggguuccccuucuggcccugggaugcuauagccaggugaauccgcucacccugacagcugccguccuuaugcugguggcucauuacgccauuaucggcccugggcuccaagcgaaggccacccgggaagcucagaaacgcacagccgcuggaaucaugaagaaccccaccguugauggcauuguggccaucgaccuggaucccgucguguaugacgccaaguuugagaaacagcuggggcagauuaugcuccuuauccuguguacgucucaaauucugcucaugagaacaaccugggcgcugugcgaaagcaucacacuugcuaccggaccucugaccacacucugggagggcuccccgggcaaguucuggaauacgaccaucgccgugucuauggcuaacauuuuucgggggagcuaccuggccggagccggccuggcuuucucccucaugaaaagccuugggggaggccgcagagggacaggagcccagggcgagacccugggcgaaaaguggaaacggcagcugaaucagcucuccaagucugaguucaacacauauaagagaagcgggaucauggaaguugaccgcuccgaggcgaaagaaggacugaagcggggcgagaccacgaaacacgccgucucuagagggacagcuaaacuucgcugguuuguggagcggaaucuggugaaacccgaaggaaaggucauugaucucggcugugggagaggaggcuggagcuacuauugcgccggccugaagaaaguuaccgaggugaagggguacaccaaaggaggcccugggcacgaagaacccaucccuauggcuacauacggauggaaccuggugaagcuccauuccggcaaagacgucuucuuuauucccccugaaaagugugauacccuucugugcgacaucggggagucuagcccgaaucccacaauugaggaaggacgcacgcugcgggugcucaaaaugguugagccuuggcugagaggcaaccaauucuguaucaagauccuuaaucccuauaugccuuccguggucgaaacccuggagcagaugcagcgcaagcacggcgggaugcucgugcggaacccccugagcagaaauucuacacaugagauguacuggguuuccugcggaaccggcaacauugugagcgccgucaauaugacaucucgcaugcugcucaaccgguuuaccauggcgcacagaaaaccgacguaugaacgcgauguggaccugggggccggaaccagacacguggcugucgagccugaaguugccaaccuugauaucauuggccagcggaucgagaauauuaagcaugaacacaaauccacauggcauuacgacgaggauaaccccuauaagaccugggcuuaccacgggagcuaugaggugaaacccucuggauccgccagcuccauggugaauggcgucgugaagcugcucacaaagccuugggacguuauccccauggugacccaaaucgcuaugacagauaccacgccuuucggccagcagcgcgucuuuaaagaaaagguggacacaagaaccccgaaagccaagcgggggaccgcgcaaauuauggagguuacagccaaauggcuguggggauuccuuagcagaaacaagaagccccggaucuguacgcgcgaagaguuuaccagaaaagugcggucuaaugcugccauuggcgcugucuucguggacgaaaaccaguggaauagcgccaaggaggccguugaggaugaacgcuuuugggaccuggugcauagagagcgggaacuccacaaacaggggaagugcgcgacaugcgucuacaacaugaugggaaaacgcgagaagaagcugggcgaguucgggaaagcuaagggcuccagagccaucugguacauguggcugggagcccgguuucucgaguucgaggcucugggcuucaugaaugaagaucacugguuuucucgcgagaacagccuuuccgggguggaaggagagggccugcauaaacucggguauauucugagagacaucucuaagaucccuggaggcaauauguacgccgaugacaccgcugggugggauacacggauuaccgaggacgaucuucagaacgaagcccgcaucacagacauuauggagcccgaacacgcgcugcucgccaaaagcaucuucaagcugaccuaucaaaauaaagucgugagaguucagcggccugcuaagaacggcacggugauggaugucauuucccgcagagaccagcggggaucuggccagguggggaccuacggacugaauacauuuaccaacauggaggcccaacucaucagacagauggaaagcgagggcaucuucucccccagcgagcuggaaacaccgaaccuugcugagcgcgugcuggauuggcucgaaaaguaugggguugagcggcugaaaagaauggccauuucuggagacgacuguguggucaagccuaucgaugaccgcuuugcgaccgcccuuacggcucugaaugauaugggcaaagugcggaaggacauuccccagugggaaccuuccaaaggguggaacgauuggcagcaaguucccuucugcagccaucacuuucaccagcucaucaugaaggacggcagagagauuguggucccuugucgcaaucaggaugagcuggugggacgggccagagucucucagggcgcuggguggucccugcgcgaaacagccugccucggaaagagcuacgcucaaauguggcagcugauguauuuccaucggagagaccuucgccuggccgcgaacgccaucuguuccgcugugcccguugauuggauuccgaccucucggacaaccuggagcauccacgcccaucaccaguggaugacgaccgaggacaugcucuccguguggaauagagucuggaucgaagagaacccuuggauggaagauaaaacacauauuagcucuuggggcgacgugcccuaccuggggaagcgggaggaccaauggugcggaucccuuaucggccugaccgccagagcuacaugggccaccaauauucagguugcgaucaaccaggugcgccggcucauugggaaugagaacuaccuggauuauaugacaagcaugaaaagauuuaagaaugaaucugaccccgagggcgcucugugguga

SEQ ID NO: 18527 - RNA, 9879 nt, Artificial Sequence
  derived and/or modified CDS sequence (opt5) from DENV-1__GU131893__SS-prME
agcgugaccaugcugcugaugcugaugcccacagcccuugcuuuccaccugacgaccagaggcggggagccucauaugaucgucuccaagcaggaacggggaaagucucuccuguuuaagaccagcgccggcguuaacaugugcacccuuauugcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugaugaccugcgccaaguuuaagugcgucacaaaacuugagggaaagaucgugcaguacgaaaaccugaaauauuccguuaucgugacgguccacaccggcgaccagcaucaaguggggaaugagagcacagaacacggaaccacagcuaccauuacgccccaggccccuaccacagagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaagggggcuacacagaacggacggcugaucacggccaaucccauuguuaccgacaaagagaagccugugaacaucgaagccgagccgcccuuuggcgagagcuauauugucaucggggcuggagaaaaagcccuuaagcucucuugguucaagaaaggcagcuccauugggaagauguuugaggcuacagccagaggcgcgcgccggauggccauccugggagauaccgcuugggacuucggcucuaucgggggaguguuuacaagcgugggcaaacugguucaucagauuuucgggaccgccuacggaguccucuuuuccggcgugagcuggacgaugaagaucgggcugggcgugcuucugaccuggcucggacucaauucuagauccacaagccugucuaugaccuguauugcugucggccuugugacacucuaccuggggguuauggugcaggccgauuccggaugcgucaucaacuggaaaggccgcgaacugaagugugggagcggaauuuucgugaccaaugagguucacacauggaccgaacaauauaaguuucaggcggacuccccuaaacggcucucugccgcuaucggcaaggccugggaggagggggugugcggcauuagaagcgcuacgcgccuggaaaacaucauguggaaacagaucuccaacgagcuuaaucauauucugcucgaaaacgacaugaaguucacagucgugguuggagauguggccggcauccuggcccaggggaaaaagaugauucggccgcaacccauggaguacaaauauucuuggaaaagcuggggaaaggcuaagaucauuggcgcggacguccagaauaccaccuuuaucaucgaugggccuaacacacccgaauguccugacgaucagagagccuggaauauuugggagguggaggacuacggauucggcaucuuuaccacgaacauuuggcugaaacuucgcgauucccacacacaggugugcgaccaccggcucaugagcgcugccaucaaagauucuaaggccguccaugcugacaugggcuauuggauugaauccgagaaaaaugaaaccuggaagcuggccagagcgagcuucaucgagguuaagacauguaucuggcccaaaucucacacccugugguccaacggggugcucgaaagcgagaugauuaucccgaagauuuacggaggcccuaucucucaacauaauuaucgccccggguacuucacacagaccgcuggaccuuggcaccugggcaaacuugagcuggauuuugaccucugcgaagggacgaccguggucguggaugagcacugcggaaaccggggccccagccugagaacaaccacaguuaccggcaagauuauccaugaaugguguugccgguccuguacgcugccuccccuucgcuucagaggggaggacggaugcugguacggcauggagauccggccggugaaagaaaaggaggaaaaucucgucaagagcauggugucugccggguccggagagguugacagcuuuucccugggccugcucuguauuucuaucaugauugaagaggugaugagaagccgcuggucccggaaaaugcugaugacagggacccuugccgucuuccugcuccugaucaugggacagcugacauggaacgaucuuauuagacugugcaucauggugggcgcuaaugccucugaccgcaugggcauggggaccaccuaucucgcgcugauggcuacauuuaagaugagaccuauguucgccguuggacuccuguuucggcgccuuacgagcagagaggugcugcuccugaccauuggccugucccuugucgccucuguggaacugcccaacagccucgaggaacugggggauggacucgcuaugggcaucaugauccugaaacuucugacagacuuccaaucccaccagcucugggccacccugcugagccuuacauuuauuaagaccacguucucucugcauuacgcuuggaaaacaauggccauggugcucuccaucgucagccuguuuccccucugucugucuaccaccucccagaagacaaccuggcuuccuguucugcuggggagccucggaugcaagccgcugacaauguuccuuauugcggagaauaaaaucuggggccggcgcucuuggccccugaacgaaggcauuauggccguggggaucguguccauccuccugagcucccuccugaagaacgaugucccucuugcuggaccccugauugccggcgggaugcugaucgcuuguuaugugauuagcggaucuagcgccgaccucucccuggagaaagccgcugagguuucuugggaagaggaagcggagcacagcggcgccucccauaauauccuuguggaaguccaggaugacgggacgaugaagauuaaagaugaggagagagacgauacccugacaauccuccugaaggcuacccuccuggccgugucuggaguuuacccucuuagcauccccgccacacuguuugugugguauuucuggcagaagaagaagcagcgguccggcguccugugggacaccccuucucccccggaaguggagcgcgcuguccucgaugacggcauuuacagaaucaugcagcgggggcugcuuggacgcagccaggugggcguugggguguuccaagaaaacgucuuucacacgauguggcacgugaccagaggagccguucugauguaucagggcaaacggcucgagccuuccugggcgagcgugaagaaagaccugauuucuuacgggggaggcuggagacuccagggcuccuggaauacaggggaggaaguccaggugaucgcuguggagcccggaaagaacccuaaaaauguucaaaccgcccccggcacauucaagaccccggaaggggaggucggagccauugcucuggauuuuaagccuggcacaagcgggucucccaucgugaaccgcgaaggaaaaauugugggccuuuacggcaauggggucgugacgaccuccggaacauauguuagcgccaucgcgcaggcuaaggccucccaggagggcccucugcccgagaucgaagacgagguguuccggaaaagaaaccugaccauuauggaucuccaucccgggucuggaaagacccgccgguaccugccugccaucgucagagaagcuauuaaacgcaaacuucggacacugauccucgccccgacgagagugguugcuagcgagauggccgaagcgcugaagggcaugcccauucgcuaucaaaccacagccgugaaauccgagcacaccgggaaggagaucgucgaccugaugugccaugcuacauuuaccaugcggcuccuuagcccugugagaguucccaauuacaacaugaucauuauggaugaagcccacuucacggacccuucuuccaucgcugcccggggcuauauuagcacacgcgugggaaugggcgaggccgcugcgaucuuuaugaccgccacacccccugggucugucgaggcuuucccgcagagcaaugccgugauucaggaugaggaaagagacauccccgagcgguccuggaacucuggauacgaguggaucacagauuuuccuggcaaaaccgugugguucguccccagcauuaaguccgggaaugacaucgccaacugucugcgcaaaaauggaaagagaguuauucagcugucucggaagacauuugauaccgaauaucagaagacgaagaacaacgacugggacuacguggugacaaccgauaucagcgagaugggcgcuaauuucagagccgaccgcgucauugauccucggagaugccucaaacccgugauccugaaggacgggccggaacgcguuauucuugcgggcccuaugcccgugacagucgcuuccgccgcccagcggagaggacgcaucggccggagccauaacaaagagggggaucaguacaucuauaugggacagccccugaauaacgacgaggaucacgcucacuggaccgaagccaagaugcuccuggacaauauuaacacgccugagggcaucauucccgcgcuguucgaaccugagagagaaaagucugccgcuaucgauggggaguaccgccucagaggagaggcccggaaaaccuuuguggaacuuaugcgcagaggcgaccugccgguuuggcuguccuauaagguggcuagcgagggguuccaauacuccgaucggcgcuggugcuuugacggcgaaagaaauaaccagguccucgaggaaaauauggauguggagauuuggacaaaagagggagaacggaagaaacugagaccccgcuggcuugacgcccggaccuauucugacccucuggcucucagagaguucaaggaauuugccgcgggccgccggagcgucuccggggaucugauccuggagaucggaaaacucccccagcaucuuacacagagagcccaaaacgcucuggacaaucuggugaugcuccacaacucugaacagggcgggcgggccuaccgccaugcuauggaggagcugccugauaccauugaaacacuuaugcugcucgcccugaucgccguucugaccggaggcgugacgcuguucuuucuuagcggcagagggcugggaaagacauccauuggccugcucugugugauggcuagcucuguccugcuuuggauggcguccguugagccccacuggaucgccgcuagcauuauccuggaguucuuucucauggugcugcugaucccggagccugaccggcagcgcacaccccaagauaaucaacucgccuauguggucauugggcuucuguucaugauccugaccguggccgcuaacgagaugggacuccuggaaaccaccaagaaagaccuuggcauugggcacguugccgugggaaaucaucaccaugcggccaugcuggaugucgaccuccacccugcuucugccuggacacuguacgcuguggccacgaccaucauuacacccaugaugagacauaccaucgagaacacaaccgcgaacauuucccugacggccaucgcuaaucaggccgcuauccucaugggccuugauaagggcuggccuauuagcaaaauggacaucggggucccccugcuggcccucggaugcuacucucaggugaacccgcugacccuuacagcugccguucugaugcucguggcgcacuaugccauuaucggcccugggcugcaagcuaaggccacccgggaagcucagaaacgcacagccgccggaauuaugaagaaucccaccgucgauggcaucguggcgaucgaccuggaucccguuguguacgacgcuaaguuugagaaacagcucgggcagauuaugcuucugauccuguguacgagccaaauucuccugaugagaacaaccugggcccuuugcgaauccaucacacuggcuaccggaccucucaccacacugugggagggcucuccgggcaaguucuggaacacgaccauugccgucagcauggccaauaucuuucggggguccuaucuggcuggagccggccucgcguucagccuuaugaaaucccucgggggaggccgcagagggacaggagcccagggcgagacccugggcgaaaaguggaaacggcagcucaaccagcugucuaagagcgaguucaauacauacaagagauccgggaucauggaaguggaccgcucugaggcuaaagaaggacuuaagcggggcgagaccacgaaacacgccgugagcagagggacagcuaagcugcgcugguuuguugagcggaaccucgucaaacccgaaggaaaggugauugaucugggcugugggagaggaggcugguccuauuacugcgccggccugaagaaagugaccgaggucaagggguauaccaaaggaggcccugggcaugaagaacccaucccuauggcgacauacggauggaaucucguuaaacuucacucuggcaaagacguguucuuuauucccccugaaaagugugauacccugcugugcgacaucggggagagcuccccgaaccccacaauugaggaaggacgcacgcuccgggugcugaaaauggucgagccuuggcuuagaggcaaucaauucuguaucaagauucugaaccccuacaugccuagcgugguugaaacccucgagcagaugcagcgcaagcauggcgggaugcuggugcggaauccccugucuagaaacuccacacacgagauguauugggucagcugcggaaccggcaauaucgugucugccguuaacaugacaucccgcaugcuccugaaucgguuuaccauggcucacagaaaaccgacguacgaacgcgauguggaccuuggggccggaaccagacaugucgcuguggagccugaaguggccaaccuggauaucauuggccagcggaucgagaacauuaagcacgaacauaaaagcacauggcacuaugacgaggauaaucccuacaagaccugggcuuaucaugggucuuacgaggucaaacccuccggaagcgccuccagcaugguuaacggcguggugaagcuccugacaaagccuugggacgucauccccauggugacccaaauugcgaugacagauaccacgccuuucggccagcagcgcguuuuuaaagaaaagguggacacaagaaccccgaaagccaagcgggggaccgcucaaaucauggaggucacagccaaauggcuuuggggauuccugucuagaaauaagaagccccggaucuguacgcgcgaagaguuuaccagaaaagugcggagcaacgcugccauuggcgccguuuucguggacgaaaaucaguggaacuccgcgaaggaggcugucgaggaugaacgcuuuugggaccucgugcacagagagcgggaacugcacaaacaggggaagugcgccacaugcguuuauaauaugaugggaaaacgcgagaagaagcugggcgaguucgggaaagccaagggcucuagagcuaucugguacauguggcucggagcccgguuucuggaguucgaggcucuuggcuucaugaacgaagaucauugguuuagccgcgaaaauucccugucugggguggaaggagagggccuccacaaacugggguacauucuuagagacaucagcaagauuccuggaggcaacauguaugccgaugacaccgcggggugggauacacggaucaccgaggacgaucugcagaaugaagcccgcaucacagacauuauggagcccgaacaugcucuccuggccaaauccaucuucaagcugaccuaccaaaacaaagucgugagaguccagcggccugcuaagaauggcacggugauggauguuauuucucgcagagaccagcggggaagcggccagguggggaccuauggacucaacacauuuaccaauauggaggcccaacugaucagacagauggaauccgagggcauuuucagccccucugagcuugaaacaccgaaccuggcggagcgcguccucguguggcuggaaaaguacgggguggagcggcuuaaaagaauggccaucuccggagaugacuguguugugaagccuaucgacgaucgcuuugcuaccgcccugacggcucucaacgacaugggcaaaguccggaaggauauuccccagugggaaccuagcaaaggguggaaugacuggcagcaagugcccuucugcucucaccacuuucaucagcugaucaugaaggauggcagagagauuguugugccuugucgcaaccaggacgagcuggucggacgggccagagugucccagggcgcuggguggagccuccgcgaaacagccugccugggaaaguccuaugcgcaaauguggcagcuuauguacuuccaccggagagaucugcgccucgccgcuaaugccaucuguucugccguccccguggacuggauuccgaccagccggacaaccugguccauccaugcucaccaucaguggaugacgaccgaggauaugcugagcguuuggaacagaguguggauugaagagaauccuuggauggaagacaaaacacacaucucuuccuggggcgauguccccuaucuugggaagcgggaggaccaauggugcggaagccugaucggccucaccgccagagcgacaugggcuaccaacauucagguggccaucaaucagguucgccggcugauugggaacgagaauuaccuggacuacaugacaucuaugaaaagauuuaagaacgaaagcgaucccgagggcgcccucugguga

SEQ ID NO: 18528 - RNA, 9879 nt, Artificial Sequence
  derived and/or modified CDS sequence (opt5) from DENV-1__GU131894__SS-prME
agcgugaccaugcugcucaugcugaugcccaccgcccuugcuuuccaccugacgaccagaggcggggagccucauaugaucguguccaagcaggaacggggaaaaucucuccuguuuaagaccagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaaguucacagugguugugggagaugucgcuggcauccucgcccaggggaaaaagaugauucggccgcaacccauggaguacaaauauucuuggaaaagcuggggaaaggccaagaucaucggcgcugacgugcagaauaccaccuuuauuaucgaugggccuaacacacccgaauguccugacgaucagagagcguggaauauuugggagguggaggacuacggauucggcaucuuuaccacgaacauuuggcugaagcugcgcgauuccuauacacaggucugcgaccaccggcuuaugagcgccgcuaucaaagauucuaaggccguucacgccgacaugggcuacuggaucgaauccgagaaaaaugaaaccuggaagcucgcuagagccagcuucauugaggugaagacauguaucuggcccaaaucucauacccugugguccaacggggugcuggaaagcgagaugauuaucccgaagauuuauggaggcccuaucucucaacacaauuaccgccccggguacuucacacagaccgcgggaccuuggcaucucggcaaacuggagcuugauuuugaccugugcgaagggacgaccgucgugguugaugagcacugcggaaaccggggccccagccucagaacaaccacagugaccggcaagaucauucacgaaugguguugccgguccuguacgcugccuccccugcgcuucagaggggaggacggaugcugguauggcauggagauccggccggucaaagaaaaggaggaaaaucuugucaagagcaugguuucugcuggguccggagagguggacagcuuuucccucggccugcuguguauuucuaucaugauugaagaggucaugagaagccgcuggucccggaaaaugcucaugacagggacccuggccguguuccuucugcucaucaugggacagcugacauggaacgaucugauuagacuuugcaucaugguuggcgccaaugcuucugaccgcaugggcauggggaccaccuaccuggcccucauggcgacauuuaagaugagaccuauguucgcugugggacugcucuuucggcgccugacgagcagagagguccuucugcucaccaucggccugucccugguggccucuguggaacuucccaacagccuggaggaacucggggauggacuggccaugggcauuaugauccucaaacugcuuacagacuuccaaucccaucagcugugggcuacccuccugagccugacauuuauuaagaccacguucucucuucacuaugccuggaaaacaauggcuaugguccuguccaucguuagccucuuuccccugugucucucuaccaccucccagaagacaaccuggcugccugugcuucuggggagccugggaugcaagccgcucacaauguuccugauugccgagaauaaaaucuggggccggcgcucuuggccccuuaacgaaggcaucauggcgguggggauugucuccauccugcucagcucccugcucaagaacgaugugccucuggccggaccccuuauugcuggcgggaugcugaucgccuguuacguuauuagcggaucuagcgcugaccugucccucgagaaagccgccgaggugucuugggaagaggaagcugagcauagcggcgcgucccacaauauccuggucgaagugcaggaugacgggacgaugaagaucaaagaugaggagagagacgauacccuuacaauucugcucaaggccacccugcucgcuguuucuggaguguauccucugagcauccccgccacacuuuuugucugguacuucuggcagaagaagaagcagcgguccggcgugcugugggacaccccuucucccccggaagucgagcgcgccgugcuggaugacggcauuuauagaaucaugcagcgggggcuccugggacgcagccagguuggcgugggggucuuccaagaaaacguguuucauacgauguggcacguuaccagaggagcugugcuuauguaccagggcaaacggcuggagccuuccugggccagcgucaagaaagaccucauuucuuacgggggaggcuggagacugcagggcuccuggaauacaggggaggaagugcaagugaucgcgguugagcccggaaagaacccuaaaaauguccaaaccgcucccggcacauucaagaccccggaaggggaggugggagccauugcccucgauuuuaagccuggcacaagcgggucucccaucgugaaccgcgaaggaaaaaucgucggccuguauggcaauggggugguuacgaccuccggaacauacgugagcgcuauugcccaggcgaaggcuucccaggagggcccucuucccgagaucgaagacgaggucuuccggaaaagaaaccugaccauuauggaucugcaccccgggucuggaaagacccgccgguaucucccugccaucgugagagaagccauuaaacgcaagcugcggacacuuauccuggcuccgacgagaguuguggccagcgagauggcugaagcccucaagggcaugcccauccgcuaccaaaccacagcggucaaauccgagcauaccgggaaggagauuguggaccugaugugccacgccacauuuaccaugcggcugcucagcccuguuagagugcccaauuauaacaugaucauuauggaugaagcucauuucacggacccuucuuccaucgccgcucggggcuacauuagcacacgcgucggaaugggcgaggccgccgcuaucuuuaugaccgcgacacccccugggucuguggaagccuucccgcagagcaaugcugugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacauuugauaccgaauaccagaaaacgaagaacaacgacugggacuacguggucacaaccgauaucagcgagaugggcgccaauuucagagcugaccgcgugauugauccucggagaugccugaaacccguuauccucaaggacgggccggaacgcgugauccuggccggcccuaugcccgucacaguggcguccgcugcccagcggagaggacgcauuggccggaaccacaauaaagagggggaucaguauaucuacaugggacagccccuuaacaaugacgaggaucaugcccacuggaccgaagcuaagaugcugcucgacaacauuaauacgccugagggcaucauucccgcccuguucgaaccugagagagaaaagagcgcggccaucgauggggaguaucgccugagaggagaggcucggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcgcaaaaugcccuugacaaccugguuaugcugcauaauuccgaacagggcgggcgggcuuaucgccacgccauggaggagcucccugauaccauugaaacacugaugcuucuggcucucaucgccgugcugaccggaggcgugacgcuguucuuucucucuggcagagggcuuggaaagacaagcauuggccugcugugugucauggccuccagcguucuccuguggauggcuucuguggagccccauuggaucgcggccuccaucauucuugaguucuuucugauggugcuccugaucccggagccugaccggcagcgcacaccccaggauaaccaacuggcuuacgucgugauugggcuccuuuucaugauccugaccguugccgccaaugagaugggacugcucgaaacaaccaagaaagaccugggcauugggcacguggcugucggaaaccaccaucacgccgcgaugcuugauguggaccugcauccugccagcgcuuggacacucuacgccgucgcuacgaccaucauuacacccaugaugagacacaccaucgagaacacaaccgccaauaucucucugacggcgauugccaaccaggcugccauccugaugggccucgauaagggcuggccuauuuccaaaauggacaucggggugccccuucuggcucugggaugcuauagccagguuaauccgcucacccugacagccgcugugcuuaugcuggucgcccauuacgcgauuaucggcccugggcuccaagccaaggcuacccgggaagcccagaaacgcacagcugccggaaucaugaagaaccccaccguggauggcauuguugccaucgaccuggaucccguggucuaugacgcgaaguuugagaaacagcuggggcagauuaugcuccuuauccuguguacgucucaaauucugcucaugagaacaaccugggcucugugcgaaagcaucacacuugccaccggaccucugaccacacucugggagggcuccccgggcaaguucuggaauacgaccaucgcugugucuauggccaacauuuuucgggggagcuaccuggccggagcuggccuggccuucucccucaugaaaagccuugggggaggccgcagagggacaggagcgcagggcgagacccugggcgaaaaguggaaacggcagcugaaucagcucuccaagucugaguucaacacauauaagagaagcgggaucauggaaguggaccgcuccgaggccaaagaaggacugaagcggggcgagaccacgaaacacgcuguuucuagagggacagccaaacuucgcugguuugucgagcggaaucuggugaaacccgaaggaaaggugauugaucucggcugugggagaggaggcuggagcuacuauugcgcuggccugaagaaagucaccgagguuaagggguacaccaaaggaggcccugggcacgaagaacccaucccuauggccacauacggauggaaccuggugaagcuccauuccggcaaagacguguucuuuauucccccugaaaagugugauacccuucugugcgacaucggggagucuagcccgaaucccacaauugaggaaggacgcacgcugcggguccucaaaaugguggagccuuggcugagaggcaaccaauucuguaucaagauccuuaaucccuauaugccuuccguuguggaaacccuggagcagaugcagcgcaagcacggcgggaugcucguccggaacccccugagcagaaauucuacacaugagauguacuggguguccugcggaaccggcaacauuguuagcgcggugaauaugacaucucgcaugcugcucaaccgguuuaccauggcccacagaaaaccgacguaugaacgcgaugucgaccugggggcuggaaccagacacguggccguggagccugaagucgcuaaccuugauaucauuggccagcggaucgagaauauuaagcaugaacacaaauccacauggcauuacgacgaggauaaccccuauaagaccugggccuaccacgggagcuaugagguuaaacccucuggauccgcuagcuccauggugaauggcguggucaagcugcucacaaagccuugggacgugauccccaugguuacccaaaucgccaugacagauaccacgccuuucggccagcagcgcguguuuaaagaaaaggucgacacaagaaccccgaaagcgaagcgggggaccgcccaaauuauggaggugacagcuaaauggcuguggggauuccuuagcagaaacaagaagccccggaucuguacgcgcgaagaguuuaccagaaaaguucggucuaaugccgcuauuggcgccguguucgucgacgaaaaccaguggaauagcgccaaggaggcgguggaggaugaacgcuuuugggaccugguucauaaagagagagaacuccacaagcaggggaaaugcgcuacaugcguguacaacaugaugggaaagcgggagaagaaacugggcgaguucgggaaggccaaaggcucccgcgccaucugguacauguggcugggagcuagauuucucgaguucgaggcccugggcuucaugaaugaagaucacugguuuucucgggagaacagccuuuccggggucgaaggagagggccugcauaagcucggguauauucugcgcgacaucucuaaaaucccuggaggcaauauguacgcugaugacaccgccgggugggauacaagaauuaccgaggacgaucuucagaacgaagcgcggaucacagacauuauggagcccgaacacgcccugcucgcuaagagcaucuucaaacugaccuaucaaaauaaggugguccgcgugcagagaccugccaagaacggcacgguuauggaugugauuucccggcgcgaccagagaggaucuggccaggucgggaccuacggacugaauacauuuaccaacauggaggcucaacucauccggcagauggaaagcgagggcaucuucucccccagcgagcuggaaacaccgaaccuugccgagagagugcuggauuggcucgaaaaauaugggguggagcgccugaagcggauggcgauuucuggagacgacuguguugugaaaccuaucgaugacagauuugccaccgcucuuacggcccugaaugauaugggcaagguccgcaaagacauuccccagugggaaccuuccaagggguggaacgauuggcagcaagugcccuucugcagccaucacuuucaccagcucaucaugaaggacggccgggagauuguugugccuuguagaaaucaggaugagcuggucggacgcgcucgggugucucagggcgccggguggucccugagagaaacagcuugccucggaaaaagcuacgcccaaauguggcagcugauguauuuccaucgccgggaccuuagacuggcggccaacgcuaucuguuccgccguccccguggauuggaccccgacaucucgcaccacguggagcauucacgcccaucaccaguggaugaccacagaggacaugcucuccguuuggaaucggguguggaucgaagagaacccuuggauggaagauaagacccauaucagcucuuggggcgacguccccuaccuggggaaaagagaggaccaauggugcggaucccuuauuggccugacagcucgggccaccugggcgacaaauauccagguggcuauuaaccagguuagacgccucaucgggaaugagaacuaccuggauuauaugaccagcaugaagcgguuuaaaaaugaaucugaccccgagggcgcccugugguga

SEQ ID NO: 18529 - RNA, 9879 nt, Artificial Sequence
  derived and/or modified CDS sequence (opt5) from DENV-1__GU131895__SS-prME
agcgugaccaugcugcucaugcugaugcccacagcccuugcuuuccaccugacgaccagaggcggggaaccucauaugaucguguccaagcaggaacggggaaaaucucuccuguuuaagaccagcgccggcguuaacaugugcacccuuaucgccauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuugcccugaaggggaugagcuauguuauguguacgggcucuuucaaacucgagaaggaaguggcggagacacagcacggaaccguccuggugcagaucaaguacgagggcaccgacgcuccgugcaaaaucccuuucuccacacaagaugaaaaggggguuacccagaacggacggcugauuacagccaaucccaucgugacggacaaagagaagccugucaacauugaagccgagccgcccuuuggcgagagcuauaucgugauuggggcuggagaaaaagcccuuaagcucucuugguucaagaaaggcagcuccaucgggaagauguuugaggcuaccgccagaggcgcgcgccggauggccauccugggagauacagcuugggacuucggcucuauugggggaguguuuaccagcguuggcaaacugguccaucagaucuucgggacagccuacggagugcucuuuuccggcgugagcuggaccaugaagauugggaucggcguccugcuuacguggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacagaacaauauaaguuucaggcggacuccccuaaacggcugucugccgcuaucggcaaggccugggaggagggggucugcggcaucagaagcgcuacccgccucgaaaacauuauguggaaacagaucuccaacgagcugaaucauauucuucuggaaaacgacaugaaguucacggugguugugggagaugucgccggcauccucgcccaggggaaaaagaugauucggccgcaacccauggaguacaaauauucuuggaaaagcuggggaaaggcuaagaucaucggcgcggacgugcagaauacaaccuuuauuaucgaugggccuaacacccccgaauguccugacgaucagagagccuggaauauuugggagguggaggacuacggauucggcaucuuuacaaccaacauuuggcugaagcugcgcgauuccuauacgcaggucugcgaccaccggcuuaugagcgcugccaucaaagauucuaaggccguucacgcugacaugggcuacuggaucgaauccgagaaaaaugaaacauggaagcucgccagagcgagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacagcuggaccuuggcaucucggcaaacuggagcuugauuuugaccugugcgaagggaccacggucgugguugaugagcacugcggaaaccggggccccagccucagaaccacaaccgugacaggcaagaucauucacgaaugguguugccgguccuguacccugccuccccugcgcuucagaggggaggacggaugcugguauggcauggagauccggccggucaaagaaaaggaggaaaaucuugucaagagcaugguuucugccggguccggagagguggacagcuuuucccucggccugcuguguauuucuaucaugauugaagaggucaugagaagccgcuggucccggaaaaugcucaugacggggacacuggccguguuccuucugcucaucaugggacagcugaccuggaacgaucugauuagacuuugcaucaugguuggcgcuaaugccucugaccgcaugggcauggggacaaccuaccuggcgcucauggcuaccuuuaagaugagaccuauguucgccgugggacugcucuuucggcgccugacaagcagagagguccuucugcucacgaucggccugucccugguggccucuguggaacuucccaacagccuggaggaacucggggauggacuggcuaugggcauuaugauccucaaacugcuuaccgacuuccaaucccaucagcugugggccacacuccugagccugaccuuuauuaagacaaccuucucucuucacuaugcuuggaaaacgauggccaugguccuguccaucguuagccucuuuccccugugucucucuacaaccucccagaagaccacauggcugccugugcuucuggggagccugggaugcaagccgcucaccauguuccugauugcggagaauaaaaucuggggccggcgcucuuggccccuuaacgaaggcaucauggccguggggauugucuccauccugcucagcucccugcucaagaacgaugugccucuggcuggaccccuuauugccggcgggaugcugaucgcuuguuacguuauuagcggaucuagcgccgaccugucccucgagaaagccgcugaggugucuugggaagaggaagcggagcauagcggcgccucccacaauauccuggucgaagugcaggaugacgggacaaugaagaucaaagaugaggagagagacgauacgcuuaccauucugcucaaggcuacacugcucgccguuucuggaguguauccucugagcauccccgccacccuuuuugucugguacuucuggcagaagaagaagcagcgguccggcgugcugugggacacaccuucucccccggaagucgagcgcgcugugcuggaugacggcauuuauagaaucaugcagcgggggcuccugggacgcagccagguuggcgugggggucuuccaagaaaacguguuucauaccauguggcacguuacgagaggagccgugcuuauguaccagggcaaacggcuggagccuuccugggcgagcgucaagaaagaccucauuucuuacgggggaggcuggagacugcagggcuccuggaauaccggggaggaagugcaagugaucgcuguugagcccggaaagaacccuaaaaauguccaaacagcccccggcaccuucaagacaccggaaggggaggugggagccauugcucucgauuuuaagccuggcaccagcgggucucccaucgugaaccgcgaaggaaaaaucgucggccuguauggcaauggggugguuacaacguccggaaccuacgugagcgccauugcgcaggcuaaggccucccaggagggcccucuucccgagaucgaagacgaggucuuccggaaaagaaaccugacaauuauggaucugcaccccgggucuggaaagacccgccgguaucucccugccaucgugagagaagcuauuaaacgcaagcugcggacccuuauccuggccccgacaagaguuguggcuagcgagauggccgaagcgcucaagggcaugcccauccgcuaccaaacgaccgccgucaaauccgagcauacagggaaggagauuguggaccugaugugccacgcuaccuuuacaaugcggcugcucagcccuguuagagugcccaauuauaacaugaucauuauggaugaagcccauuucaccgacccuucuuccaucgcugcccggggcuacauuagcacgcgcgucggaaugggcgaggccgcugcgaucuuuaugacagccacacccccugggucuguggaggcuuucccgcagagcaaugccgugauccaggaugaggaaagagacauucccgagcgguccuggaacucuggauaugaguggaucaccgauuuuccuggcaaaacagucugguucguucccagcauuaaguccgggaaugacaucgccaacugucuucgcaaaaauggaaagagagugauucagcugucucggaagaccuuugauacagaauaccagaaaaccaagaacaacgacugggacuacguggucacgacagauaucagcgagaugggcgcuaauuucagagccgaccgcgugauugauccucggagaugccugaaacccguuauccucaaggacgggccggaacgcgugauccuggcgggcccuaugcccgucaccguggcuuccgccgcccagcggagaggacgcauuggccggaaccacaauaaagagggggaucaguauaucuacaugggacagccccuuaacaaugacgaggaucaugcucacuggacagaagccaagaugcugcucgacaacauuaauaccccugagggcaucauucccgcgcuguucgaaccugagagagaaaagagcgccgcuaucgauggggaguaucgccugagaggagaggcccggaaaacguuuguugaacucaugcgcagaggcgaccuuccgguguggcugucuuacaaggucgcuuccgagggguuccaauauagcgaucggcgcuggugcuuugacggcgaaagaaacaaucaggugcuggaggaaaacauggaugucgagaucuggaccaaagagggagaacggaagaaacucagaccccgcuggcuggacgcccggacauacuccgacccucuugcucugagagaguucaaggaauuugccgcgggccgccggucugugagcggggaucucauucuggagaucggaaaacugccccagcaccucacccagagagcccaaaaugcucuugacaaccugguuaugcugcauaauuccgaacagggcgggcgggccuaucgccacgcuauggaggagcucccugauacaauugaaacccugaugcuucuggcccucaucgccgugcugacaggaggcgugacccuguucuuucucucuggcagagggcuuggaaagacgagcauuggccugcugugugucauggcuuccagcguucuccuguggauggcgucuguggagccccauuggaucgccgcuuccaucauucuugaguucuuucugauggugcuccugaucccggagccugaccggcagcgcacaccccaggauaaccaacuggccuacgucgugauugggcuccuuuucaugauccugaccguugccgcuaaugagaugggacugcucgaaaccacaaagaaagaccugggcauugggcacguggccgucggaaaccaccaucacgcggccaugcuugauguggaccugcauccugcuagcgccuggacccucuacgcugucgccacaacgaucauuacccccaugaugagacacacaaucgagaacaccacagcgaauaucucucugaccgccauugcuaaccaggccgcuauccugaugggccucgauaagggcuggccuauuuccaaaauggacaucggggugccccuucuggcccugggaugcuauagccagguuaauccgcucacgcugaccgcugccgugcuuaugcuggucgcgcauuacgccauuaucggcccugggcuccaagcuaaggccacacgggaagcucagaaacgcaccgccgccggaaucaugaagaaccccacaguggauggcauuguugcgaucgaccuggaucccguggucuaugacgcuaaguuugagaaacagcuggggcagauuaugcuccuuauccuguguaccucucaaauucugcucaugagaacgacaugggcccugugcgaaagcaucacccuugcuacaggaccucugaccacccucugggagggcuccccgggcaaguucuggaauacaacgaucgccgugucuauggccaacauuuuucgggggagcuaccuggcuggagccggccuggcguucucccucaugaaaagccuugggggaggccgcagagggaccggagcccagggcgagacacugggcgaaaaguggaaacggcagcugaaucagcucuccaagucugaguucaacaccuauaagagaagcgggaucauggaaguggaccgcuccgaggcuaaagaaggacugaagcggggcgagacaaccaaacacgccguuucuagagggacggcuaaacuucgcugguuugucgagcggaaucuggugaaacccgaaggaaaggugauugaucucggcugugggagaggaggcuggagcuacuauugcgccggccugaagaaagucacagagguuaagggguacaccaaaggaggcccugggcacgaagaacccaucccuauggcgaccuacggauggaaccuggugaagcuccauuccggcaaagacguguucuuuauucccccugaaaagugugauacacuucugugcgacaucggggagucuagcccgaaucccaccauugaggaaggacgcacacugcggguccucaaaaugguggagccuuggcugagaggcaaccaauucuguaucaagauccuuaaucccuauaugccuuccguuguggaaacgcuggagcagaugcagcgcaagcacggcgggaugcucguccggaacccccugagcagaaauucuacccaugagauguacuggguguccugcggaacaggcaacauuguuagcgccgugaauaugaccucucgcaugcugcucaaccgguuuacaauggcucacagaaaaccgaccuaugaacgcgaugucgaccugggggccggaacgagacacguggcuguggagccugaagucgccaaccuugauaucauuggccagcggaucgagaauauuaagcaugaacacaaauccaccuggcauuacgacgaggauaaccccuauaagacaugggcuuaccacgggagcuaugagguuaaacccucuggauccgccagcuccauggugaauggcguggucaagcugcucaccaagccuugggacgugauccccaugguuacacaaaucgcgaugaccgauacaaccccuuucggccagcagcgcguguuuaaagaaaaggucgacacgagaacaccgaaagccaagcgggggaccgcucaaauuauggaggugaccgccaaauggcuguggggauuccuuagcagaaacaagaagccccggaucuguacacgcgaagaguuuacgagaaaaguucggucuaaugcugccauuggcgccguguucgucgacgaaaaccaguggaauagcgcgaaggaggcuguggaggaugaacgcuuuugggaccugguucauaaagagagagaacuccacaagcaggggaaaugcgcgaccugcguguacaacaugaugggaaagcgggagaagaaacugggcgaguucgggaaggccaaaggcucccgcgcuaucugguacauguggcugggagccagauuucucgaguucgaggcucugggcuucaugaaugaagaucacugguuuucucgggagaacagccuuuccggggucgaaggagagggccugcauaagcucggguauauucugcgcgacaucucuaaaaucccuggaggcaauauguacgccgaugacacagcggggugggauaccagaauuacagaggacgaucuucagaacgaagcccggaucaccgacauuauggagcccgaacacgcucugcucgccaagagcaucuucaaacugacauaucaaaauaaggugguccgcgugcagagaccugcuaagaacggcaccguuauggaugugauuucccggcgcgaccagagaggaucuggccaggucgggacguacggacugaauaccuuuacaaacauggaggcccaacucauccggcagauggaaagcgagggcaucuucucccccagcgagcuggaaaccccgaaccuugcggagagagugcuggauuggcucgaaaaauaugggguggagcgccugaagcggauggccauuucuggagacgacuguguugugaaaccuaucgaugacagauuugcuacagcccuuaccgcucugaaugauaugggcaagguccgcaaagacauuccccagugggaaccuuccaagggguggaacgauuggcagcaagugcccuucugcagccaucacuuucaccagcucaucaugaaggacggccgggagauuguugugccuuguagaaaucaggaugagcuggucggacgcgcccgggugucucagggcgcuggguggucccugagagaaacggccugccucggaaaaagcuacgcgcaaauguggcagcugauguauuuccaucgccgggaccuuagacuggccgcuaacgccaucuguuccgccguccccguggauuggauuccgacaucucgcaccacauggagcauccacgcucaucaccaguggaugaccacggaggacaugcucuccguuuggaaucggguguggaucgaagagaacccuuggauggaagauaagacccauauuagcucuuggggcgacguccccuaccuggggaaaagagaggaccaauggugcggaucccuuaucggccugacagcccgggcgaccugggcuacaaauauucagguggccaucaaccagguuagacgccucauugggaaugagaacuaccuggauuauaugaccagcaugaagcgguuuaaaaaugaaucugaccccgagggcgcccugugguga

SEQ ID NO: 18530 - RNA, 9879 nt, Artificial Sequence
  derived and/or modified CDS sequence (opt5) from DENV-1__GQ868632__SS-prME
agcgugaccaugcugcucaugcugaugcccaccgcccuugcuuuccaccugacgaccagaggaggggagccucauaugaucgucuccaagcaggaacggggaaaaucucuccuguuuaagaccagcgccggcguuaacaugugcacccuuaucgcgauggaccugggggagcucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaggacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggguuagcuaugugauguguacaggcucuuucaaacucgagaaggaagucgccgagacccagcacggaaccgugcugguucagaucaaguacgagggcacagacgcgccgugcaaaaucccuuucuccacccaagaugaaaagggggugacacagaacggacggcugauuacggcuaaucccaucgucaccgacaaagagaagccugugaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcaucagaagcgccacgcgccucgaaaacauuauguggaaacagaucuccaacgagcugaaucauauucuucuggaaaacgacaugaaguucacaguuguggucggagauguggcuggcauccucgcccaggggaaaaagaugauucggccgcaacccauggaguacaaauauucuuggaaaagcuggggaaaggccaaaaucaucggcgcugacgugcagaauaccaccuuuauuaucgaugggccuaacacacccgaauguccugacgagcagagagcguggaauauuugggaggucgaagauuacggauucggcaucuuuaccacgaacauuuggcugaagcugcgcgacuccuauacacagguuugcgaucaccggcuuaugagcgccgcuaucaaagacucuaaggccgugcacgccgauaugggcuacuggaucgaguccgaaaagaaugagaccuggaagcucgcuagagccagcuucauugaagugaagacauguaucuggcccaaaucucauacccugugguccaacgggguccuggagagcgagaugauuaucccgaagauuuauggaggcccuaucucucaacacaauuaccgccccggguacuucacacagaccgcgggaccuuggcaucucggcaaacuggaacuugacuuugaucugugcgaggggacgaccgugguuguggacgaacacugcggaaaccggggccccagccucagaacaaccacagucaccggcaagaucauucacgagugguguugccgguccuguacgcugccuccccugcgcuucagaggggaggauggaugcugguauggcauggaaauccggccggugaaagagagagaagagaaucuuguuaagagcauggugucugcuggguccggagaagucgacagcuuuucccucggccugcuguguauuucuaucaugauugaggaggugaugcgcagccggugguccagaaagaugcucaugacagggacccuggccguuuuccuucugcucaucaugggacagcugacauggaacgaccugauucgccuuugcaucauggugggcgccaaugcuucugauagaaugggcauggggaccaccuaccuggcccucauggcgacauuuaaaaugcggccuauguucgcugucggacugcucuuucgcagacugacgagccgggaagugcuucugcucaccaucggccugucccugguggccucugucgagcuucccaacagccuggaggaacucggggacggacuggccaugggcauuaugauccucaagcugcuuacagauuuccaaucccaucagcugugggcuacccuccugagccugacauuuauuaaaaccacguucucucuucacuaugccuggaagacaauggcuaugguucuguccaucgugagccucuuuccccugugucucucuaccaccucccagaaaacaaccuggcugccugugcuucuggggagccugggaugcaagccgcucacaauguuccugauugccgaaaauaagaucuggggccgcagaucuuggccccuuaacgagggcaucauggcggucgggauuguguccauccugcucagcuccuuucugaaaaacgacguuccucucgccggaccccugauugcuggcgggaugcuuaucgccuguuacgugauuagcggaucuagcgcugaucugucccuggagaaggccgccgaagucucuugggaggaagaggcugaacauagcggcgcgucccacaauauccucguggagguucaggacgaugggacgaugaaaaucaaggacgaggaacgggaugacacccugacaauucuucugaaagccacccuccuggcugugucuggagucuauccucucagcauccccgccacacuguucgugugguacuucuggcaaaagaaaaagcagcgcuccggcguccuuugggauaccccuucucccccggagguggaaagagccguucuggacgauggcauuuaucggaucaugcagcgcgggcugcucggaagaagccaggugggcgucgggguguuucaagagaacguuuuccauacgauguggcacgugacccggggagcuguccugauguaccagggcaagagacuugagccuuccugggccagcgugaaaaaggaccugauuucuuacgggggaggcuggcgccuccagggcuccuggaauacaggggaagaggugcagguuaucgcggucgaacccggcaagaacccuaagaaugugcaaaccgcucccggcacauuuaaaaccccggagggggaagugggagccauugcccuggacuucaagccuggcacaagcgggucucccaucgucaaccgggagggaaagaucgugggccucuauggcaaugggguugugacgaccuccggaacauacgucagcgcuauugcccaggcgaaggcuucccaggagggcccucugcccgaaaucgaggaugaaguguuuagaaagcgcaaccuuaccauuauggaccugcaccccgggucuggaaaaacccggagauaucugccugccaucguucgcgaggccauuaagcggaaacucagaacacugauccuugcuccgacgcgcguggucgccagcgaaauggcugaggcccugaagggcaugcccauccgguaccaaaccacagcggugaaguccgagcauaccgggaaagaaauuguugaucucaugugccacgccacauucaccaugagacugcugagcccugugcggguccccaauuauaacaugaucauuauggacgaggcucauuuuacggauccuucuuccaucgccgcucgcggcuacauuagcacaagagugggaaugggcgaagccgccgcuaucuucaugaccgcgacacccccugggucuguggaggccuuuccgcagagcaaugcugucauccaggacgaggaacgggauauucccgagcgcuccuggaacucuggauaugaauggaucacagacuucccuggcaagaccguuugguuugugcccagcauuaaauccgggaaugauaucgccaacugucucagaaagaauggaaaacgggugauucagcuuucuagaaagacauucgacaccgaguaccaaaagacgaaaaacaacgauugggacuacgucgugacaaccgacaucagcgaaaugggcgccaauuuccgcgcugaucggguuauugacccuagacgcugccugaagcccgugauccugaaagaugggccggagcgggucauccucgccggcccuaugcccgugacaguugcguccgcugcccagagacgcggacggauuggcagaaaccacaauaaggagggggaccaguauaucuacaugggacagccccugaacaaugaugaagaccaugcccacuggaccgaggcuaaaaugcuucuggauaacauuaauacgccugaaggcaucauucccgcccucuuugagccugaacgcgagaaaagcgcggccaucgacggggaguauagacugcggggagaagcucgcaagaccuucguggagcugaugagacggggcgaucucccggucuggcuuucuuacaaaguggccuccgaaggguuucaauauagcgaccgcagauggugcuucgauggcgagcggaacaaucagguccuggaagagaacauggacguggagaucuggacaaaggaaggagagcgcaaaaagcugcgcccccgguggcucgaugcuagaaccuacuccgacccucuggcccuucgcgaauuuaaagaguucgcugccggccggagaucuguuagcggggaccugauucucgaaaucggaaagcugccccagcaccugacacagcgggcgcaaaaugcccucgauaaccuugugaugcugcauaauuccgagcagggcgggcgcgcuuauagacacgccauggaggaacugccugacaccauugagacacucaugcugcuugcucugaucgccgugcucaccggaggcgucacgcuguuuuuccugucuggccgggggcucggaaaaacaagcauuggccuucuguguguuauggccuccagcgugcugcucuggauggcuucuguggaaccccauuggaucgcggccuccaucauucuggaguuuuuccuuaugguccugcucaucccggagccugaucgccagagaacaccccaggacaaccaacuggcuuacgugguuauugggcugcucuuuaugauccuuaccguggccgccaaugaaaugggacugcuggagacaaccaagaaggaucucggcauugggcacgucgcugugggaaaccaccaucacgccgcgaugcuggacgucgaucuucauccugccagcgcuuggacacuguacgccguggcuacgaccaucauuacacccaugaugcggcacaccaucgaaaacacaaccgccaauaucucucucacggcgauugccaaccaggcugccauccugaugggccuggacaaaggcuggccuauuuccaagauggauaucgggguuccccuccuugcucugggaugcuauagccaggugaauccgcugacccucacagccgcuguccugaugcuuguggcccauuacgcgauuaucggcccugggcugcaagccaaagcuacccgcgaggcccagaagagaacagcugccggaaucaugaaaaaccccaccguugacggcauuguggccaucgaucucgaccccgucguguaugaugcgaaguucgaaaagcagcuggggcagauuaugcugcucauccuuuguacgucucaaauucugcugaugcggacaaccugggcucucugcgagagcaucacacuggccaccggaccucuuaccacacugugggagggcuccccgggcaaauuuuggaauacgaccaucgcugugucuauggccaacauuuuccgcgggagcuaccucgccggagcuggccuggccuucucccugaugaaaagccucgggggaggcagacgggggacaggagcgcagggcgaaacccuuggcgagaaauggaagagacagcugaaucagcuguccaaaucugaauuuaacacauauaagcgcagcgggaucauggagguugaccgguccgaagccaaggagggacucaaaagaggcgagaccacgaagcacgcugucucucgcgggacagccaaacugcggugguucguggaaagaaaucuugugaagcccgagggaaaagucauugaccugggcugugggcgcggaggcuggagcuacuauugcgcuggccucaagaagguuaccgaagugaaaggguacaccaagggaggcccugggcacgaggaacccaucccuauggccacauacggauggaaccuggugaaacugcauuccggcaaggaugucuuuuucauucccccugagaaaugugacacccuccuuugcgauaucggggagucuagcccgaaucccacaauugaagagggacggacgcugagagugcugaagaugguugaaccuuggcuccgcggcaaccaauuuuguaucaaaauccugaaucccuauaugccuuccguggucgagacccuugagcagaugcagcggaagcacggcgggaugcuggugagaaacccccucagccgcaauucuacacaugaaauguacuggguuuccugcggaaccggcaacauugugagcgcggucaauaugacaucucggaugcugcugaacagauucaccauggcccaccgcaagccgacguaugagagagacguggaucucggggcuggaacccggcacguggccgucgaaccugagguugcuaaccuggacaucauuggccagcgcaucgaaaauauuaaacaugagcacaaguccacauggcauuacgaugaggacaaccccuauaaaaccugggccuaccacgggagcuaugaagugaagcccucuggauccgcuagcuccauggugaauggcgucgugaaacuucugacaaagccuugggauguuauccccauggugacccaaaucgccaugacagacaccacgccuuuuggccagcagagagucuucaaggagaaaguggauacacggaccccgaaggcgaaaagagggaccgcccaaauuauggaaguuacagcuaaguggcucuggggauuucugagccggaacaaaaagccccgcaucuguacgagagaggaguucacccggaaggugcgcucuaaugccgcuauuggcgccgucuuuguggacgagaaccaguggaauagcgccaaagaggcgguugaagacgagagauucugggaucuugugcauaaggaacgggagcugcacaaacaggggaagugcgcuacaugcgucuacaacaugaugggaaaacgcgaaaagaagcucggcgaguuugggaaagccaagggcuccagagccaucugguacauguggcugggagcucgguuccuggaguucgaagcccucggcuuuaugaaugaggaccacugguucucucgcgaaaacagccuguccgggguggagggagagggccuucauaaacugggguauauucucagagauaucucuaagaucccuggaggcaauauguacgcugacgauaccgccgggugggacacacggauuaccgaagaugaccugcagaacgaggcgcgcaucacagauauuauggaacccgagcacgcccuucuggcuaaaagcaucuuuaagcucaccuaucaaaauaaagucgugagaguucagcggccugccaagaacggcacggugauggacgucauuucccgcagagaucagcggggaucuggccagguggggaccuacggacugaauacauucaccaacauggaagcucaacugaucagacagauggagagcgagggcaucuuuucccccagcgaacucgagacaccgaaccuggccgaacgcgugcuugacuggcuggagaaguaugggguugaacggcucaaaagaauggcgauuucuggagaugacuguguggucaagccuaucgacgaucgcuucgccaccgcucugacggcccuuaaugacaugggcaaagugcggaaggauauuccccagugggagccuuccaaaggguggaacgacuggcagcaaguucccuuuugcagccaucacuuccaccagcugaucaugaaggauggcagagagauuguggucccuugucgcaaucaggacgaacucgugggacgggcuagagucucucagggcgccggguggucccugcgcgagacagcuugccugggaaagagcuacgcccaaauguggcagcucauguauuuucaucggagagaucugcgccuugcggccaacgcuaucuguuccgccgugcccguugacuggauuccgaccucucggacaaccuggagcauccacgcccaucaccaguggaugacgaccgaagauaugcuguccguguggaauagagucuggaucgaggaaaacccuuggauggaggacaaaacacauauuagcucuuggggcgaugugcccuaccucgggaagcgggaggaccaauggugcggaucccugaucggccuuaccgcuagagccacaugggcgaccaauauucagguugcuaucaaccaggugcgccggcugauugggaaugaaaacuaccucgacuauaugacaagcaugaaaagauucaagaaugagucugaucccgaaggcgcccugugguga

SEQ ID NO: 18531 - RNA, 9879 nt, Artificial Sequence
  derived and/or modified CDS sequence (opt5) from DENV-1__GQ868633__SS-prME
agcgugaccaugcugcucaugcugaugcccaccgcccuugcuuuccaccugacgaccagaggcggggagccucauaugaucguguccaagcaggaacggggaaaaucucuccuguuuaagaccagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaaguucacagugguugugggagaugucgcuggcauccucgcccaggggaaaaagaugauucggccgcaacccauggaguacaaauauucuuggaaaagcuggggaaaggccaagaucaucggcgcugacgugcagaauaccaccuuuauuaucgaugggccuaacacacccgaauguccugacgaucagagagcguggaauauuugggagguggaggacuacggauucggcaucuuuaccacgaacauuuggcugaagcugcgcgauuccuauacacaggucugcgaccaccggcuuaugagcgccgcuaucaaagauucuaaggccguucacgccgacaugggcuacuggaucgaauccgagaaaaaugaaaccuggaagcucgcuagagccagcuucauugaggugaagacauguaucuggcccaaaucucauacccugugguccaacggggugcuggaaagcgagaugauuaucccgaagauuuauggaggcccuaucucucaacacaauuaccgccccggguacuucacacagaccgcgggaccuuggcaucucggcaaacuggagcuugauuuugaccugugcgaagggacgaccgucgugguugaugagcacugcggaaaccggggccccagccucagaacaaccacagugaccggcaagaucauucacgaaugguguugccgguccuguacgcugccuccccugcgcuucagaggggaggacggaugcugguauggcauggagauccggccggucaaagaaaaggaggaaaaucuugucaagagcaugguuucugcuggguccggagagguggacagcuuuucccucggccugcuguguauuucuaucaugauugaagaggucaugagaagccgcuggucccggaaaaugcucaugacagggacccuggccguguuccuucugcucaucaugggacagcugacauggaacgaucugauuagacuuugcaucaugguuggcgccaaugcuucugaccgcaugggcauggggaccaccuaccuggcccucauggcgacauuuaagaugagaccuauguucgcugugggacugcucuuucggcgccugacgagcagagagguccuucugcucaccaucggccugucccugguggccucuguggaacuucccaacagccuggaggaacucggggauggacuggccaugggcauuaugauccucaaacugcuuacagacuuccaaucccaucagcugugggcuacccuccugagccugacauuuauuaagaccacguucucucuucacuaugccuggaaaacaauggcuaugguccuguccaucguuagccucuuuccccugugucucucuaccaccucccagaagacaaccuggcugccugugcuucuggggagccugggaugcaagccgcucacaauguuccugauugccgagaauaaaaucuggggccggcgcucuuggccccuuaacgaaggcaucauggcgguggggauugucuccauccugcucagcucccugcucaagaacgaugugccucuggccggaccccuuauugcuggcgggaugcugaucgccuguuacguuauuagcggaucuagcgcugaccugucccucgagaaagccgccgaggugucuugggaagaggaagcugagcauagcggcgcgucccacaauauccuggucgaagugcaggaugacgggacgaugaagaucaaagaugaggagagagacgauacccuuacaauucugcucaaggccacccugcucgcuguuucuggaguguauccucugagcauccccgccacacuuuuugucugguacuucuggcagaagaagaagcagcgguccggcgugcugugggacaccccuucucccccggaagucgagcgcgccgugcuggaugacggcauuuauagaaucaugcagcgggggcuccugggacgcagccagguuggcgugggggucuuccaagaaaacguguuucauacgauguggcacguuaccagaggagcugugcuuauguaccagggcaaacggcuggagccuuccugggccagcgucaagaaagaccucauuucuuacgggggaggcuggagacugcagggcuccuggaauacaggggaggaagugcaagugaucgcgguugagcccggaaagaacccuaaaaauguccaaaccgcucccggcacauucaagaccccggaaggggaggugggagccauugcccucgauuuuaagccuggcacaagcgggucucccaucgugaaccgcgaaggaaaaaucgucggccuguauggcaauggggugguuacgaccuccggaacauacgugagcgcuauugcccaggcgaaggcuucccaggagggcccucuucccgagaucgaagacgaggucuuccggaaaagaaaccugaccauuauggaucugcaccccgggucuggaaagacccgccgguaucucccugccaucgugagagaagccauuaaacgcaagcugcggacacuuauccuggcuccgacgagaguuguggccagcgagauggcugaagcccucaagggcaugcccauccgcuaccaaaccacagcggucaaauccgagcauaccgggaaggagauuguggaccugaugugccacgccacauuuaccaugcggcugcucagcccuguuagagugcccaauuauaacaugaucauuauggaugaagcucauuucacggacccuucuuccaucgccgcucggggcuacauuagcacacgcgucggaaugggcgaggccgccgcuaucuuuaugaccgcgacacccccugggucuguggaagccuucccgcagagcaaugcugugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacauuugauaccgaauaccagaaaacgaagaacaacgacugggacuacguggucacaaccgauaucagcgagaugggcgccaauuucagagcugaccgcgugauugauccucggagaugccugaaacccguuauccucaaggacgggccggaacgcgugauccuggccggcccuaugcccgucacaguggcguccgcugcccagcggagaggacgcauuggccggaaccacaauaaagagggggaucaguauaucuacaugggacagccccuuaacaaugacgaggaucaugcccacuggaccgaagcuaagaugcugcucgacaacauuaauacgccugagggcaucauucccgcccuguucgaaccugagagagaaaagagcgcggccaucgauggggaguaucgccugagaggagaggcucggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcgcaaaaugcccuugacaaccugguuaugcugcauaauuccgaacagggcgggcgggcuuaucgccacgccauggaggagcucccugauaccauugaaacacugaugcuucuggcucucaucgccgugcugaccggaggcgugacgcuguucuuucucucuggcagagggcuuggaaagacaagcauuggccugcugugugucauggccuccagcguucuccuguggauggcuucuguggagccccauuggaucgcggccuccaucauucuugaguucuuucugauggugcuccugaucccggagccugaccggcagcgcacaccccaggauaaccaacuggcuuacgucgugauugggcuccuuuucaugauccugaccguugccgccaaugagaugggacugcucgaaacaaccaagaaagaccugggcauugggcacguggcugucggaaaccaccaucacgccgcgaugcuugauguggaccugcauccugccagcgcuuggacacucuacgccgucgcuacgaccaucauuacacccaugaugagacacaccaucgagaacacaaccgccaauaucucucugacggcgauugccaaccaggcugccauccugaugggccucgauaagggcuggccuauuuccaaaauggacaucggggugccccuucuggcucugggaugcuauagccagguuaauccgcucacccugacagccgcugugcuuaugcuggucgcccauuacgcgauuaucggcccugggcuccaagccaaggcuacccgggaagcccagaaacgcacagcugccggaaucaugaagaaccccaccguggauggcauuguugccaucgaccuggaucccguggucuaugacgcgaaguuugagaaacagcuggggcagauuaugcuccuuauccuguguacgucucaaauucugcucaugagaacaaccugggcucugugcgaaagcaucacacuugccaccggaccucugaccacacucugggagggcuccccgggcaaguucuggaauacgaccaucgcugugucuauggccaacauuuuucgggggagcuaccuggccggagcuggccuggccuucucccucaugaaaagccuugggggaggccgcagagggacaggagcgcagggcgagacccugggcgaaaaguggaaacggcagcugaaucagcucuccaagucugaguucaacacauauaagagaagcgggaucauggaaguggaccgcuccgaggccaaagaaggacugaagcggggcgaggcuaccaaacacgccguuucuagagggcccgcuaaacuucgcugguuugucgagcggaaucuggugaacccugaaggaaaagugauugaucucggcugugggagaggaggcuggagcuacuauugcgccggccugaagaaggucacggagguuaaaggguacacaaagggaggccccgggcacgaagaaccuauccccauggcgaccuacggauggaaucuggugaaacuccauuccggcaaggacguguucuuuauuccuccggaaaaaugugauacccuucugugcgacaucggggagucuagccccaacccuacaauugaggaaggacgcacccugcggguccucaagaugguggagcccuggcugagaggcaaucaauucuguaucaaaauccuuaacccuuauaugcccuccguuguggaaacacuggagcagaugcagcgcaagcacggcgggaugcucguccggaauccgcugagcagaaacucuacgcaugagauguacuggguguccugcggaaccggcaauauuguuagcgccgugaacaugacaucucgcaugcugcucaaccgguuuaccauggcucacagaaagccuacauaugaacgcgaugucgaccugggggccggaaccagacacguggcuguggagcccgaagucgccaaucuugauaucauuggccagcggaucgagaacauuaaacaugaacacaaguccacguggcauuacgacgaggauaaucccuauaaaaccugggcuuaccacgggagcuaugagguuaagccuucuggauccgccagcuccauggugaacggcguggucaaacugcucacaaagcccugggacgugaucccuaugguuacccaaaucgcgaugacagauaccacaccguucggccagcagcgcguguuuaaggaaaaagucgacaccagaacgcccaaggccaaacgggggacagcucaaauuauggaggugaccgccaaguggcuguggggauuccuuagcagaaauaaaaagccucggaucuguacccgcgaagaguuuacaagaaagguucggucuaacgcugccauuggcgccguguucgucgacgaaaaucaguggaacagcgcgaaagaggcuguggaggaugaacgcuuuugggaccugguucauaaggagagagaacuccacaaacaggggaagugcgccacgugcguguacaauaugaugggaaaacgggagaagaagcugggcgaguucgggaaagccaagggcucccgcgcuaucugguacauguggcugggagccagauuucucgaguucgaggcucugggcuucaugaacgaagaucacugggucucucgggagaauagccuuuccgggguggaaggagagggccugcauaaacucggguauauucugcgcgacaucucuaagauccccggaggcaacauguacgccgaugacaccgcggggugggauacaagaauuaccgaggacgaucuucagaaugaagcccggaucacagacauuauggagccugaacacgcucugcucgccaaaagcaucuuuaagcugaccuaucaaaacaaagucgugcgcguucagagacccgcuaagaauggcacagugauggaugucauuucccggcgcgaccagagaggaucuggccagguggggaccuacggacugaacacguucaccaacauggaggcccaacucauccggcagauggaaagcgagggcaucuuuuccccgagcgagcuggaaacaccuaaucuugcggagagagugcuggauuggcucgaaaaguaugggguugagcgccugaaacggauggccauuucuggagacgacuguguggucaagcccaucgaugacagauucgcuaccgcccuuacagcucugaacgauaugggcaaagugcgcaaggacauuccucagugggaacccuccaaaggguggaaugauuggcagcaaguuccuuuuuggagccaucacuuccaccagcucaucaugaaggacggccgggagauugugguccccugcagaaaccaggaugagcuggugggacgcgcccgggucucucagggcgcuggguggucccugagagaaaccgccugucucggaaagagcuacgcgcaaauguggcagcugauguauuuucaucgccgggaccuuagacuggccgcuaaugccaucugcuccgccgugccgguugauuggauuccuacgucucgcacaaccuggagcauccacgcucaucaccaguggaugacaaccgaggacaugcucuccguguggaaccgggucuggaucgaagagaaucccuggauggaagauaaaacgcauauuagcucuuggggcgacgugcccuaccuggggaagagagaggaccaaugguguggaucccuuaucggccugaccgcccgggcgacaugggcuaccaacauucagguugccaucaaucaggugagacgccucauugggaacgagaauuaccuggauuauaugacaagcaugaaacgguucaagaacgaaucugacccugagggcgcccugugguga

SEQ ID NO: 18532 - RNA, 9879 nt, Artificial Sequence
  derived and/or modified CDS sequence (opt5) from DENV-1__GU131919__SS-prME
agcgugaccaugcugcucaugcugaugcccacagcccuugcuuuccaccugacgaccagaggcggggagccucauaugaucgucuccaagcaggaacggggaaagucucuccuguuuaagaccagcgccggcguuaacaugugcacccuuaucgcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuuccugacccaagaugaaaaggggguuacacagaacggacggcuuauuacggcuaaucccaucgugaccgacaaagagaagccugucaacauugaagccgagccgcccuuuggcgaguccuauaucgugauuggggccggagaaaaagcucucaagcugagcugguucaagaaaggcucuagcaucgggaagauguuugaggccacagcuagaggcgcccgccggauggcgauccugggagauaccgccugggacuucggcuccauugggggaguguuuacaucuguuggcaaacucauccaucagauuuucgggaccgcuuacggaguccuguuuagcggcguguccuggacgaugaagaucgggauuggcgugcuucugaccuggcucggacugaauagcagaucuacaucccugagcaugaccuguaucgccgucggccuugugacacucuaccuggggguuauggugcaggcugauucuggaugcgucauuaacuggaaaggccgcgaacugaaguguggguccggaaucuucgugaccaaugagguucacacauggaccgaacaauauaaguuucaggccgacagcccuaaacggcucuccgcggccaucggcaaggcuugggaggagggggugugcggcauuagaucugccacgcgccuggaaaacaucauguggaaacagauuagcaacgagcuuaaucauauccugcucgaaaacgacaugaaguucacagucgugguuggagauguggcuggcauucuggcccaggggaaaaagaugauccggccgcaacccauggaguacaaauauuccuggaagucuuggggaaaggccaaaaucauuggcgcugacguccagaauaccaccuuuaucauugaugggccuaacacacccgaauguccugacgaucagagagcguggaauaucugggagguggaggacuacggauucggcauuuuuaccacgaacaucuggcugaaacuucgcgauagcuauacacaggugugcgaccaccggcucauguccgccgcuaucaaagauagcaaggccguccacgccgacaugggcuacuggauugaaucugagaaaaaugaaaccuggaagcuggcuagagccuccuucaucgagguuaagacauguauuuggcccaaaagccauacccuguggucuaacggggugcucgaauccgagaugaucauuccgaagaucuauggaggcccuaucagccaacacaauuaccgccccggguacuucacacagaccgcgggaccuuggcaucugggcaaacuugagcuggauuuugaccucugcgaagggacgaccguggucguggaugagcacugcggaaaccggggccccucucugagaacaaccacaguuaccggcaagauuauccacgaaugguguugccggagcuguacgcugccuccccuucgcuucagaggggaggacggaugcugguauggcauggagauucggccggugaaagaaaaggaggaaaaucucgucaaguccauggugagcgcugggucuggagagguugacuccuuuagccugggccugcucuguaucuccauuaugaucgaagaggugaugagaucucgcuggagccggaaaaugcugaugacagggacccuugccgucuuccugcuccugauuaugggacagcugacauggaacgaucuuaucagacugugcaucauggugggcgccaaugcuugugaccgcaugggcauggggaccaccuaccucgcccugauggcgacauuuaagaugagaccuauguucgcuguuggacuccuguuucggcgccuuacguccagagaggugcugcuccugaccauuggccugucucuugucgccagcguggaacugcccaacucccucgaggaacugggggauggacucgccaugggcaucaugauucugaaacuucugacagacuuccaaucuuaucagcucugggcuacccugcugagccuuacauuuaucaagaccacguucucccugcauuacgccuggaaaacaauggcuauggugcucagcauugucucucuguuuccccucugccuguccaccaccagccagaagacaaccuggcuuccuguucugcuggggucucucggauguaagccgcugacaauguuccuuaucgccgagaauaaaaucuggggccggcgcuccuggccccugaacgaaggcauuauggcgguggggaucgugagcauucuccugucuucccuccugaagaacgaugucccucuugccggaccccugaucgcuggcgggaugcugauugccugcuaugugaucagcggauccagcgcugaccucucucuggagaaagccgccgagguuagcugggaagaggaagcugagcacuccggcgcgucucauaauauccuuguggaaguccaggaugacgggacgaugaagauuaaagaugaggagagagacgauacccugacaauccuccugaaggccacccuccuggcugugagcggaguuuacccucuuuccauucccgccacacuguuugugugguauuucuggcagaagaagaagcagcggucuggcguccugugggacaccccuagcccucccgaaguggagcgcgccguccucgaugacggcaucuacagaauuaugcagcgggggcugcuuggacgcucccaggugggcguugggguguuccaagaaaacgucuuucacacgauguggcaugugaccagaggagcuguucugauguaccagggcaaacggcucgagcccucuugggccagcgugaagaaagaccugaucuccuaugggggaggcuggagacuccagggcagcuggaauacaggggaggaaguccaggugauugcgguggagcccggaaagaacccuaaaaauguucaaaccgcucccggcacauucaagaccccggaaggggaggucggagccaucgcccuggauuuuaagccuggcacaucugggucccccaucgugaaccgcgaaggaaaaauugugggccuuuacggcaauggggucgugacgaccagcggaacauauguuucugcuaucgcccaggcgaaggcuucccaggagggcccucugcccgagauugaagacgagguguuccggaaaagaaaccugaccaucauggaucuccaccccgggagcggaaagacccgccgguaccugccugccauugucagagaagccaucaaacgcaaacuucggacacugauccucgcuccgacgagagugguugccuccgagauggcugaagcccugaagggcaugcccauucgcuaucaaaccacagcggugaaaucugagcacaccgggaaggagaucgucgaccugaugugucaugccacauuuaccaugcggcuccuuagcccugugagaguucccaauuacaacaugauuaucauggaugaagcucacuucacggacccuuccagcauugccgcucggggcuauaucucuacacgcgugggaaugggcgaggccgccgcuaucuuuaugaccgcgacacccccuggguccgucgaagccuucccgcagagcaaugcugugauucaggaugaggaaagagacauccccgagcggucuuggaacagcggauacgaguggauuacagauuuuccuggcaaaaccgugugguucguccccuccaucaagucugggaaugacauugccaacugccugcgcaaaaauggaaagagaguuauccagcugagccggaagacauuugauaccgaauaccagaagacgaagaacaacgacugggacuauguggugacaaccgauauuuccgagaugggcgccaauuucagagcugaccgcgucaucgauccucggagaugccucaaacccgugauccugaaggacgggccggaacgcguuauucuugccggcccuaugcccgugacagucgcgucugcugcccagcggagaggacgcaucggccggaaccauaauaaagagggggaucaguacauuuauaugggacagccccugaacaaugacgaggaucacgcccauuggaccgaagcuaagaugcuccuggacaacaucaauacgccugagggcauuauccccgcccuguucgaaccugagagagaaaagagcgcggccaucgauggggaguaccgccucagaggagaggcucggaaaaccuuuguggaacuuaugcgcagaggcgaccugccgguuuggcuguccuauaagguggccagcgagggguuccaauacucugaucggcgcugguguuuugacggcgaaagaaacaaucagguccucgaggaaaacauggauguggagauuuggacaaaagagggagaacggaagaaacugagaccccgcuggcuugacgcucggaccuauuccgacccucuggcccucagagaguucaaggaauuugcugccggccgccggagcgucuccggggaucugauccuggagauuggaaaacucccccagcaccuuacacagagagcgcaaaaugcccuggacaaccuggugaugcuccacaauucugaacagggcgggcgggcuuaccgccaugccauggaggagcugccugauaccaucgaaacacuuaugcugcucgcucugauugccguucugaccggaggcgugacgcuguucuuucuuagcggcagagggcugggaaagacauccaucggccugcucugcgugauggccucuagcguccugcuuuggauggcuuccguugagccccacuggaucgcggccagcauuauccuggaguucuuucucauggugcugcugauuccggagccugaccggcagcgcacaccccaagauaaccaacucgcuuacguggucaucgggcuucuguucaugauucugaccguggccgccaaugagaugggacuccuggaaaccaccaagaaagaccuuggcaucgggcauguugcugugggaaaccaccaccaugccgcgaugcuggaugucgaccuccacccugccucugcuuggacacuguaugccguggcuacgaccauuaucacacccaugaugagacauaccaucgagaacacaaccgccaauauuucccugacggcgaucgccaaccaggcugccauucucaugggccuugauaagggcuggccuaucagcaaaauggacauuggggucccccugcuggcucucggauguuacucucaggugaauccgcugacccuuacagccgcuguucugaugcucguggcccacuaugcgaucaucggcccugggcugcaagccaaggcuacccgggaagcccagaaacgcacagcugccggaauuaugaagaaccccaccgucgauggcaucguggccauugaccuggaucccguuguguacgacgcgaaguuugagaaacagcucgggcagaucaugcuucugauucugugcacgucccaaauccuccugaugagaacaaccugggcucuuugugaaagcaucacacuggccaccggaccucucaccacacugugggagggcucuccgggcaaguucuggaauacgaccauugcugucagcauggccaacaucuuucggggguccuaucuggccggagcuggccucgccuucucucuuaugaaaagccucgggggaggccgcagagggacaggagcgcagggcgagacccugggcgaaaaguggaaacggcagcucaaucagcuguccaagagcgaguucaacacauacaagagauccgggauuauggaaguggaccgcucugaggccaaagaaggacuuaagcggggcgagaccacgaaacaugcugugagcagagggacagccaagcugcgcugguuuguugagcggaaucucgucaaacccgaaggaaaggugaucgaucugggcugcgggagaggaggcugguccuauuacugugcuggccugaagaaagugaccgaggucaagggguacaccaaaggaggcccugggcacgaagaacccauuccuauggccacauauggauggaaccucguuaaacuucacucuggcaaagacguguucuuuauucccccugaaaagugcgauacccugcugugugacaucggggagagcuccccgaaucccacaaucgaggaaggacgcacgcuccgggugcugaaaauggucgagccuuggcuuagaggcaaccaauucugcaucaagauucugaaucccuacaugccuucugugguugaaacccucgagcagaugcagcgcaagcauggcgggaugcuggugcggaacccccugagcagaaauuccacacacgagauguauugggucagcuguggaaccggcaacaucgugucugcgguuaauaugacaucccgcaugcuccugaaccgguuuaccauggcccauagaaaaccgacguacgaacgcgauguggaccuuggggcuggaaccagacacgucgccguggagccugaaguggcuaaccuggauauuaucggccagcggauugagaauaucaagcacgaacauaaaagcacauggcacuaugacgaggauaaccccuacaagaccugggccuaucaugggucuuacgaggucaaacccuccggaagcgcuucuuccaugguuaauggcguggugaagcuccugacaaagccuugggacgucauccccauggugacccaaauugccaugacagauaccacgccuuucggccagcagcgcguuuuuaaagaaaagguggacacaagaaccccgaaagcgaagcgggggaccgcccaaaucauggaggucacagcuaaauggcuuuggggauuccugagcagaaacaagaagccccggauuugcacgcgcgaagaguuuaccagaaaagugcgguccaaugccgcuaucggcgccguuuucguggacgaaaaccaguggaauagcgccaaggaggcggucgaggaugaacgcuuuugggaccucgugcacagagagcgggaacugcauaaacaggggaagugcgcuacauguguuuacaacaugaugggaaaacgcgagaagaagcugggcgaguucgggaaagccaagggcucuagagccauuugguauauguggcucggagcucgguuucuggaguucgaggcccuuggcuucaugaaugaagaucacugguuuagccgcgagaacucccugucugggguggaaggagagggccuccacaaacugggguacauccuuagagacaucagcaagauuccuggaggcaauauguaugcugaugacaccgccgggugggauacacggaucaccgaggacgaucugcagaacgaagcgcgcauuacagacaucauggagcccgaacaugcccuccuggcuaaauccauuuucaagcugaccuaccaaaauaaagucgugagaguccagcggccugccaagaacggcacggugauggauguuaucucucgcagagaccagcggggaagcggccagguggggaccuauggacucaauacauuuaccaacauggaggcucaacugaucagacagauggaauccgagggcauuuucucucccagcgagcuugaaacaccgaaccuggccgagcgcguccucgauuggcuggaaaaguacgggguggagcggcuuaaaagaauggcgaucuccggagacgacugcgugguuaagccuauugaugaccgcuuugccaccgcucugacggcccucaaugauaugggcaaagugcggaaggacaucccccagugggaaccuagcaaaggguggaacgauuggcagcaaguccccuucuguucucaccauuuucaccagcugauuaugaaggacggcagagagaucgugguuccuugccgcaaucaggaugagcuggugggacgggcuagagucucccagggcgccggguggagccuccgcgaaacagcuugucugggaaagucuuaugcccaaauguggcagcuuauguacuuccaccggagagaccugcgccucgcggccaacgcuauuugcuccgccgugcccgucgauuggaucccgaccagccggacaaccugguccauccaugcccaccaucaguggaugacgaccgaggacaugcugucuguguggaauagaguuuggauugaagagaacccuuggauggaagauaaaacacacaucagcuccuggggcgacgugcccuaccuugggaagcgggaggaccaaugguguggaagccugauuggccucaccgcuagagccacaugggcgaccaauauccaggucgcuauuaaccaggugcgccggcugaucgggaaugagaacuaucuggauuacaugacaucuaugaaaagauuuaagaaugaauccgaccccgagggcgcccucugguga

SEQ ID NO: 18533 - RNA, 9879 nt, Artificial Sequence
  derived and/or modified CDS sequence (opt5) from DENV-1__GU131920__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagagcaggacgcuaacuucgugugccggcgcacauuuguggauagaggcuggggcaauggguguggacucuucggcaaagggucucugaucaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacagagagaaaccugucaacauugaagccgagccccccuuuggcgagagcuauaucgugauuggggccggagaaaaggcucuuaaacucucuugguucaagaagggcagcuccaucgggaaaauguuugaggccacagcucgcggcgcccggagaauggcgauccugggagauaccgccugggacuucggcucuauugggggaguguuuacaagcguuggcaagcugguccaucagaucuucgggaccgcuuacggagugcucuuuuccggcgugagcuggacgaugaaaauugggaucggcguccugcuuaccuggcugggacucaauucucgcuccacaagccugucuaugaccuguauugccgugggccugguuacacuuuaccucggggugaugguccaggcugauuccggaugcgugaucaacuggaagggccgggaacugaaaugugggagcggaauuuucguuaccaaugaggugcacacauggaccgaacaauauaaguuucaggccgacuccccuaagagacugucugcggccaucggcaaagcuugggaggagggggucugcggcauccgcagcgccacgcggcucgaaaacauuauguggaagcagaucuccaacgagcugaaucauauucuucuggaaaacgacaugaaauucacagugguugugggagaugucgcuggcauccucgcccaggggaagaaaaugauuagaccgcaacccauggaguacaaguauucuuggaaaagcuggggaaaggccaagaucaucggcgcugacgugcagaauaccaccuuuauuaucgaugggccuaacacacccgaauguccugacgaucagcgcgcguggaauauuugggagguggaggacuacggauucggcaucuuuaccacgaacauuuggcugaaacugcgggauuccuauacacaggucugcgaccacagacuuaugagcgccgcuaucaaggauucuaaagccguucacgccgacaugggcuacuggaucgaauccgagaagaaugaaaccuggaaacucgcucgcgccagcuucauugaggugaagacauguaucuggcccaagucucauacccugugguccaacggggugcuggaaagcgagaugauuaucccgaaaauuuauggaggcccuaucucucaacacaauuaccggcccggguacuucacacagaccgcgggaccuuggcaucucggcaagcuggagcuugauuuugaccugugcgaagggacgaccgucgugguugaugagcacugcggaaacagaggccccagccuccggacaaccacagugaccggcaaaaucauucacgaaugguguugccgcuccuguacgcugccuccccugagauuccggggggaggacggaugcugguauggcauggagaucagaccggucaaggaaaaagaggaaaaucuugugaagagcaugguuucugcuggguccggagagguggacagcuuuucccucggccugcuguguauuucuaucaugauugaagaggucaugcgcagccggugguccagaaagaugcucaugacagggacccuggccguguuccuucugcucaucaugggacagcugacauggaacgaucugauucgccuuugcaucaugguuggcgccaaugcuucugacagaaugggcauggggaccaccuaccuggcccucauggcgacauuuaaaaugcggccuauguucgcugugggacugcucuuucgcagacugacgagccgggagguccuucugcucaccaucggccugucccugguggccucuguggaacuucccaacagccuggaggaacucggggauggacuggccaugggcauuaugauccucaagcugcuuacagacuuccaaucccaucagcugugggcuacccuccugagccugacauuuauuaaaaccacguucucucuucacuaugccuggaagacaauggcuaugguccuguccaucguuagccucuuuccccugugucucucuaccaccucccagaaaacaaccuggcugccugugcuucuggggagccugggaugcaagccgcucacaauguuccugauugccgagaauaagaucuggggccgcagaucuuggccccuuaacgaaggcaucauggcgguggggauugucuccauccugcucagcucccugcucaaaaacgaugugccucuggccggaccccuuauugcuggcgggaugcugaucgccuguuacguuauuagcggaucuagcgcugaccugucccucgagaaggccgccgaggugucuugggaagaggaagcugagcauagcggcgcgucccacaauauccuggucgaagugcaggaugacgggacgaugaaaaucaaggaugaggagcgggacgauacccuuacaauucugcucaaagccacccugcucgcuguuucuggaguguauccucugagcauccccgccacacuuuuugucugguacuucuggcaaaagaaaaagcagcgcuccggcgugcugugggacaccccuucucccccggaagucgagagagccgugcuggaugacggcauuuaucggaucaugcagcgcgggcuccugggaagaagccagguuggcgugggggucuuccaagaaaacguguuucauacgauguggcacguuacccggggagcugugcuuauguaccagggcaagagacuggagccuuccugggccagcgucaaaaaggaccucauuucuuacgggggaggcuggcgccugcagggcuccuggaauacaggggaggaagugcaggugaucgcgguugagcccggaaaaaacccuaagaauguccaaaccgcucccggcacauucaaaaccccggaaggggaggugggagccauugcccucgauuuuaagccuggcacaagcgggucucccaucgugaaccgggaaggaaagaucgucggccuguauggcaauggggugguuacgaccuccggaacauacgugagcgcuauugcccaggcgaaagcuucccaggagggcccucuucccgagaucgaagacgaggucuucagaaagcgcaaccugaccauuauggaucugcaccccgggucuggaaaaacccggagauaucucccugccaucgugcgcgaagccauuaagcggagacugcgcacacuuauccuggcuccgacgcggguuguggccagcgagauggcugaagcccucaaaggcaugcccaucagauaccaaaccacagcggucaaguccgagcauaccgggaaggagauuguggaccugaugugccacgccacauuuaccaugcggcugcucagcccuguucgcgugcccaauuauaacaugaucauuauggaugaagcucauuucacggacccuucuuccaucgccgcuagaggcuacauuagcacacgggucggaaugggcgaggccgccgcuaucuuuaugaccgcgacccccccugggucuguggaagccuucccgcagagcaaugcugugauccaggaugaggaacgcgacauucccgagagauccuggaacucuggauaugaguggaucacagauuuuccuggcaaaaccgucugguucguucccagcauuaaguccgggaaugacaucgccaacugucuucggaaaaauggaaagagagugauucagcugucucgcaaaacauuugauaccgaauaccaaaagacgaagaacaacgacugggacuacguggucacaaccgauaucagcgagaugggcgccaauuuccgggcugacagagugauugauccucgccggugccugaaacccguuauccucaaggacgggccggaaagagugauccuggccggcccuaugcccgucacaguggcguccgcugcccagcgccggggaagaauuggccgcaaccacaauaaagagggggaucaguauaucuacaugggacagccccuuaacaaugacgaggaucaugcccacuggaccgaagcuaagaugcugcucgacaacauuaauacgccugagggcaucauucccgcccuguucgaaccugagagagaaaaaagcgcggccaucgauggggaguaucggcugcgcggagaggcuagaaagaccuuuguugaacucaugcggcgcggcgaccuuccgguguggcugucuuacaaggucgccuccgagggguuccaauauagcgauagacgguggugcuuugacggcgaaagaaacaaucaggugcuggaggaaaacauggaugucgagaucuggacaaaagagggagaacgcaagaaacuccggcccagauggcuggacgcucgcaccuacuccgacccucuugcccugcgggaguucaaggaauuugcugccggcagacggucugugagcggggaucucauucuggagaucggaaaacugccccagcaccucacacagcgcgcgcaaaaugcccuugacaaccugguuaugcugcauaauuccgaacagggcgggagagcuuaucggcacgccauggaggagcucccugauaccauugaaacacugaugcuucuggcucucaucgccgugcugaccggaggcgugacgcuguucuuucucucuggccgcgggcuuggaaagacaagcauuggccugcugugugucauggccuccagcguucuccuguggauggcuucuguggagccccauuggaucgcggccuccaucauucuugaauucuuucugauggugcuccugaucccggagccugacagacagcggaccccccaggauaaccaacuggcuuacgucgugauugggcuccuuuucaugauccugaccguugccgccaaugagaugggacugcucgaaacaaccaaaaaggaccugggcauugggcacguggcugucggaaaccaccaucacgccgcgaugcuugauguggaccugcauccugccagcgcuuggacacucuacgccgucgcuacgaccaucauuacacccaugaugcgccacaccaucgagaacacaaccgccaauaucucucugacggcgauugccaaccaggcugccauccugaugggccucgauaagggcuggccuauuuccaaaauggacaucggggugccccuucuggcucugggaugcuauagccagguuaauccgcucacccugacagccgcugugcuuaugcuggucgcccauuacgcgauuaucggcccugggcuccaagccaaggcuaccagagaagcccagaaacggacagcugccggaaucaugaagaaccccaccguggauggcauuguugccaucgaccuggaucccguggucuaugacgcgaaauuugagaagcagcuggggcagauuaugcuccuuauccuguguacgucucaaauucugcucaugcgcacaaccugggcucugugcgaaagcaucacacuugccaccggaccucugaccacacucugggagggcuccccgggcaaguucuggaauacgaccaucgcugugucuauggccaacauuuuuagagggagcuaccuggccggagcuggccuggccuucucccucaugaaaagccuugggggaggccggagagggacaggagcgcagggcgagacccugggcgaaaaguggaaacgccagcugaaucagcucuccaagucugaguucaacacauauaaacggagcgggaucauggaaguggacagauccgaggccaaggaaggacugaagcgcggcgagaccacgaaacacgcuguuucucgggggacagccaagcuuagaugguuugucgagcgcaaucuggugaaacccgaaggaaaggugauugaucucggcugugggcggggaggcuggagcuacuauugcgcuggccugaaaaaggucaccgagguuaagggguacaccaaaggaggcccugggcacgaagagcccaucccuauggccacauacggauggaaccuggugaagcuccauuccggcaaagacguguucuuuauucccccugaaaagugugauacccuucugugcgacaucggggagucuagcccgaaucccacaauugaggaaggaagaacgcugcgcguccucaaaaugguggagccuuggcugcggggcaaccaauucuguaucaagauccuuaaucccuauaugccuuccguuguggaaacccuggagcagaugcagagaaaacacggcgggaugcucguccgcaacccccugagccggaauucuacacaugagauguacuggguguccugcggaaccggcaacauuguuagcgcggugaauaugacaucuagaaugcugcucaaccgcuuuaccauggcccacagaaagccgacguaugaacgggaugucgaccugggggcuggaacccgccacguggccguggagccugaagucgcuaaccuugauaucauuggccagagaaucgagaauauuaagcaugaacacaaauccacauggcauuacgacgaggauaaccccuauaagaccugggccuaccacgggagcuaugagguuaaacccucuggauccgcuagcuccauggugaauggcguggucaagcugcucacaaaaccuugggacgugauccccaugguuacccaaaucgccaugacagauaccacgccuuucggccagcagcggguguuuaaggaaaaggucgacacaagaaccccgaaagcgaagcgggggaccgcccaaauuauggaggugacagcuaaauggcuguggggauuccuuagccgcaacaagaaacccagaaucuguacgcgggaagaguuuacccgcaagguuagaucuaaugccgcuauuggcgccguguucgucgacgaaaaccaguggaauagcgccaaggaggcgguggaggaugaacgguuuugggaccugguucauaaagagcgcgaacuccacaagcaggggaaaugcgcuacaugcguguacaacaugaugggaaagagagagaaaaagcugggcgaauucgggaaggccaaaggcucccgggccaucugguacauguggcugggagcucgcuuucucgaguucgaggcccugggcuucaugaaugaagaucacugguuuucuagagagaacagccuuuccggggucgaaggagagggccugcauaagcucggguauauucugcgggacaucucuaaaaucccuggaggcaauauguacgcugaugacaccgccgggugggauacacgcauuaccgaggacgaucuucagaacgaagcgagaaucacagacauuauggagcccgaacacgcccugcucgcuaagagcaucuucaaacugaccuaucaaaauaaggugguccgggugcagcgcccugccaaaaacggcacgguuauggaugugauuuccagacgggaccagagaggaucuggccaggucgggaccuacggacugaauacauuuaccaacauggaggcucaacucauccgccagauggaaagcgagggcaucuucucccccagcgagcuggaaacaccgaaccuugccgagcgggugcuggauuggcucgaaaaguaugggguggagagacugaagcgcauggcgauuucuggagacgacuguguugugaaaccuaucgaugaccgguuugccaccgcucuuacggcccugaaugauaugggcaaggucagaaaagacauuccccagugggaaccuuccaagggguggaacgauuggcagcaagugcccuucugcagccaucacuuucaccagcucaucaugaaagacggccgcgagauuguugugccuugucggaaucaggaugagcuggucggaagagcucgcgugucucagggcgccggguggucccugcgggaaacagcuugccucggaaagagcuacgcccaaauguggcagcugauguauuuccauagacgcgaccuucggcuggcggccaacgcuaucuguuccgccguccccguggauuggauuccgaccucuagaacaaccuggagcauccacgcccaucaccaguggaugacgaccgaggacaugcucuccguuuggaaucggguguggaucgaagagaacccuuggauggaagauaagacacauauuagcucuuggggcgacguccccuaccuggggaaaagagaggaccaauggugcggaucccuuaucggccugaccgcucgcgccacaugggcgaccaauauucagguggcuaucaaccagguucggagacucauugggaaugagaacuaccuggauuauaugacaagcaugaagcgcuuuaaaaaugaaucugaccccgagggcgcccugugguga

SEQ ID NO: 18534 - RNA, 9879 nt, Artificial Sequence
  derived and/or modified CDS sequence (opt5) from DENV-1__GU131921__SS-prME
agcgugacaaugcugcucaugcugaugcccacagcccuugcuuuccaccugacgacccggggaggggaaccucauaugaucguguccaagcaggaacggggaaaaucucuccuguuuaagacaagcgccggcguuaacaugugcacccuuaucgcgauggaccugggggaacucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugauggcccuuuuucuggcgcaugccaucgggacaucuauuacccagaagggaaucaucuucauucuccugaugcuugucaccccuagcauggcuaugagaugcgugggcaucgggucccgggauuuuguugagggacugagcggcgccacauggguggacgucgugcucgagcacgggucuugugugacgaccauggcuaaggauaaacccacacuggacauugaacugcucaagaccgaggucacaaacccugccauccugcgcaaacuuugcauugaagcgaagaucuccaauaccacgacagauagcagauguccgacccaaggagaggccacccugguugaagaacaggacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuaucgugacgguccacaccggcgaccagcaucaaguggggaaugagagcacagaacacggaaccacagcuaccauuacgccccaggccccuaugaccgagauccagcucacagacuacggcgcccugacccuggauuguucuccccggacaggccucgacuucaacgaaaugguucugcuuaccaugaaggagaaauccuggcuggugcauaagcagugguuucucgaucugccucuucccuggacgagcggggcuuccacaucucaagagaccuggaaucgccaggaccugcucgucacauucaaaaccgcgcacgccaagaagcaggaaguggucgugcugggaagccaagagggcgcuaugcacaccgcccugacaggggccacggaaauucagaccuccggaacaaccacaaucuuugcuggccaucucaaaugcagacugaagauggauaaacuuacccugaaggggaugagcuauguuauguguacgggcucuuucaaacucgagaaggaaguggccgagacacagcacggaaccguccuggugcagauuaaguacgagggcaccgacgcgccgugcaaaaucccuuucuccacacaagaugaaaaggggguuacccagaacggacggcugaucacagcuaaucccauugugacggacaaagagaagccugucaacaucgaagccgagccgcccuuuggcgagagcuauauugugaucggggccggagaaaaagcucuuaagcucucuugguucaagaaaggcagcuccauugggaagauguuugaggccaccgcuagaggcgcccgccggauggcgauccugggagauacagccugggacuucggcucuaucgggggaguguuuaccagcguuggcaaacugguccaucagauuuucggggcugccuacggagugcucuuuuccggcgugagcuggacaaugaagaucgggauuggcguccugcuuaccuggcugggacucaauucuagauccacgagccugucuaugaccuguaucgcugugggccugguuacacuuuaccucggggugaugguccaggccgauuccggaugcgugauuaacuggaaaggccgcgaacugaagugugggagcggaaucuucguuaccaaugaggugcacacauggaccgaacaauauaaguuucaggcggacuccccuaaacggcugucugccgcuauuggcaaggccugggaggagggggucugcggcaucagaagcgcuacacgccucgaaaacaucauguggaaacagauuuccaacgagcugaaucauauccuucuggaaaacgacaugaaguucaccgugguugugggagaugucgccggcauucucgcccaggggaaaaagaugauccggccgcaacccauggaguacaaauauucuuggaaaagcuggggaaaggcuaagauuaucggcgcggacgugcagaauacgacauuuaucauugaugggccuaacacccccgaauguccugacgaucagagagccuggaauaucugggagguggaggacuacggauucggcauuuuuaccacaaacaucuggcugaagcugcgcgauuccuauacccaggucugcgaccaccggcuuaugagcgcugccauuaaagauucuaaggccguucacgcugacaugggcuacuggaucgaauccgagaaaaaugaaacguggaagcucgccagagcgagcuucaucgaggugaagacauguauuuggcccaaaucucauacccugugguccaacggggugcuggaaagcgagaugaucauuccgaagaucuauggaggcccuauuucucaacacaauuaccgccccggguacuucacacagaccgcuggaccuuggcaucucggcaaacuggagcuugauuuugaccugugcgaagggacaaccgucgugguugaugagcacugcggaaaccggggccccagccucagaacgaccacagugaccggcaagaucauccacgaaugguguugccgguccuguacacugccuccccugcgcuucagaggggaggacggaugcugguauggcauggagauucggccggucaaagaaaaggaggaaaaucuugucaagagcaugguuucugccggguccggagagguggacagcuuuucccucggccugcuguguaucucuauuaugaucgaagaggucaugagaagccgcuggucccggaaaaugcucaugaccgggacgcuggccguguuccuucugcucauuaugggacagcugacauggaacgaucugaucagacuuugcauuaugguuggcgcuaaugccucugaccgcaugggcauggggaccacauaccuggcgcucauggcuaccuuuaagaugagaccuauguucgccgugggacugcucuuucggcgccugaccagcagagagguccuucugcucacaaucggccugucccugguggccucuguggaacuucccaacagccuggaggaacucggggauggacuggcuaugggcaucaugauucucaaacugcuuacggacuuccaaucccaucagcugugggccacccuccugagccugacauuuaucaagaccacauucucucuucacuaugcuuggaaaaccauggccaugguccuguccauuguuagccucuuuccccugugucucucuacgacaucccagaagaccaccuggcugccugugcuucuggggagccugggaugcaagccgcucacaauguuccugaucgcggagaauaaaauuuggggccggcgcucuuggccccuuaacgaaggcaucauggccguggggaucgucuccauucugcucagcucccugcucaagaacgaugugccucuggcuggaccccuuaucgccggcgggaugcugauugcuuguuacguuaucagcggaucuagcgccgaccugucccucgagaaagccgcugaggugucuugggaagaggaagcggagcauagcggcgccucccacaauauucuggucgaagugcaggaugacgggaccaugaagaucaaagaugaggagagagacgauacacuuacgauccugcucaaggcuacccugcucgccguuucuggaguguauccucugagcauucccgccacacuuuuugucugguacuucuggcagaagaagaagcagcgguccggcgugcugugggacaccccuucucccccggaagucgagaaagcugugcuggaugacggcaucuaucgcauuaugcagagagggcuccugggacggagccagguuggcgugggggucuuccaagaaaacguguuucauacaauguggcacguuacccgcggagccgugcuuauguaccagggcaagagacuggagccuuccugggcgagcgucaaaaaggaccucaucucuuacgggggaggcuggcggcugcagggcuccuggaauacgggggaggaagugcaagugauugcuguugagcccggcaaaaacccuaagaauguccaaaccgcccccggcacauucaagaccccggaaggggaggugggagccaucgcucucgauuuuaaaccuggcacaagcgggucucccauugugaacagagaaggaaagaucgucggccuguauggcaauggggugguuaccacauccggaacguacgugagcgccaucgcgcaggcuaaagccucccaggagggcccucuucccgagauugaagacgaggucuuccgcaagcggaaccugaccaucauggaucugcaccccgggucuggaaaaacaagacgcuaucucccugccauugugcgggaagcuaucaagagaaagcugcgcacccuuauucuggccccgacccggguuguggcuagcgagauggccgaagcgcucaaaggcaugcccaucagauaccaaacaacggccgucaaguccgagcauaccgggaaagagaucguggaccugaugugccacgcuacauuuaccaugcgccugcucagcccuguucgggugcccaauuauaacaugauuaucauggaugaagcccauuucacagacccuucuuccauugcugccagaggcuacaucagcacccgggucggaaugggcgaggccgcugcgauuuuuaugacggccacacccccugggucuguggaggcuuucccgcagagcaaugccgugauccaggaugaggaacgcgacauccccgagagauccuggaacucuggauaugaguggauuaccgauuuuccuggcaagaccgucugguucguucccagcaucaaauccgggaaugacauugccaacugucuucggaagaauggaaagcgcgugauccagcugucuagaaaaacauuugauaccgaauaccaaaagaccaaaaacaacgacugggacuacguggucaccacggauauuagcgagaugggcgcuaauuuccgggccgacagagugaucgauccucgccggugccugaagcccguuauucucaaagacgggccggaaagagugauccuggcgggcccuaugcccgucacaguggcuuccgccgcccagcgccggggaagaaucggccgcaaccacaauaaggagggggaucaguauauuuacaugggacagccccuuaacaaugacgaggaucaugcucacuggaccgaagccaagaugcugcucgacaacaucaauacaccugagggcauuauccccgcgcuguucgaaccugagcgggagaaaagcgccgcuauugauggggaguauagacugcgcggagaggccagaaagaccuuuguugaacucaugcggcgcggcgaccuuccgguguggcugucuuacaaagucgcuuccgagggguuccaauauagcgauagacgguggugcuuugacggcgaacgcaacaaucaggugcuggaggaaaacauggaugucgagaucuggacgaaggagggagaacgcaaaaagcuccggcccagauggcuggacgcccgcaccuacuccgacccucuugcucugcgggaguucaaagaauuugccgcgggcagacgcucugugagcggggaucucauccuggagauuggaaagcugccccagcaccucacacagcgggcccaaaaugcucuugacaaccugguuaugcugcauaauuccgaacagggcgggagagccuaucggcacgcuauggaggagcucccugauaccaucgaaacacugaugcuucuggcccucauugccgugcugaccggaggcgugacacuguucuuucucucuggccgcgggcuuggaaagaccagcaucggccugcugugugucauggcuuccagcguucuccuguggauggcgucuguggagccccauuggauugccgcuuccaucauccuugaguucuuucugauggugcuccugauuccggagccugacagacagcggacgccccaggauaaccaacuggccuacgucgugaucgggcuccuuuucaugauucugacaguugccgcuaaugagaugggacugcucgaaaccaccaaaaaggaccugggcaucgggcacguggccgucggaaaccaccaucacgcggccaugcuugauguggaccugcauccugcuagcgccuggacacucuacgcugucgccaccacaauuaucacgcccaugaugcgccacaccauugagaacacaaccgcgaauaucucucugacagccaucgcuaaccaggccgcuauucugaugggccucgauaaaggcuggccuaucuccaagauggacauuggggugccccuucuggcccugggaugcuauagccagguuaauccgcucacccugacggcugccgugcuuaugcuggucgcgcauuacgccaucauuggcccugggcuccaagcuaaagccaccagagaagcucagaagcggacagccgccggaaucaugaagaaccccaccguggauggcaucguugcgauugaccuggaucccguggucuaugacgcuaaauuugagaagcagcuggggcagaucaugcuccuuauucuguguacaucucaaauccugcucaugcgcaccacgugggcccugugcgaaagcauuacacuugcuaccggaccucugacaacccucugggagggcuccccgggcaaauucuggaauaccacaaucgccgugucuauggccaacaucuuuagagggagcuaccuggcuggagccggccuggcguucucccucaugaaaagccuugggggaggccggcgcgggacgggagcccagggcgagacccugggcgaaaaauggaagagacagcugaaucagcucuccaagucugaguucaacacauauaaacggagcgggauuauggaaguggacagauccgaggcuaaggaaggacugaaacgcggcgagaccacaaagcacgccguuucucgggggaccgcuaaacuuagaugguuugucgagcgcaaucuggugaagcccgaaggaaaggugaucgaucucggcugugggcggggaggcuggagcuacuauugcgccggccugaaaaaggucacggagguuaaaggguacacaaagggaggcccugggcacgaagaacccauuccuauggcgaccuacggauggaaccuggugaaacuccauuccggcaaggacguguucuuuauucccccugaaaaaugugauacccuucugugcgacauuggggagucuagcccgaaucccacaaucgaggaaggaagaacccugcgcguccucaagaugguggagccuuggcugcggggcaaccaauucuguauuaagauccuuaaucccuauaugccuuccguuguggaaacacuggagcagaugcagagaaaacacggcgggaugcucguccgcaacccccugagcagaaauucuacgcaugagauguacuggguguccugcggaaccggcaacaucguuagcgccgugaauaugacaucuagaaugcugcucaaccgcuuuaccauggcucaccggaagccgacauaugaaagagaugucgaccugggggccggaacccgccacguggcuguggagccugaagucgccaaccuugauauuaucggccagagaauugagaauaucaaacaugaacacaaguccacguggcauuacgacgaggauaaccccuauaaaaccugggcuuaccacgggagcuaugagguuaagcccucuggauccgccagcuccauggugaauggcguggucaagcugcucacaaaaccuugggacgugauucccaugguuacccaaaucgcgaugacagauaccacaccuuucggccagcagcggguguuuaaggaaaaagucgacacccgcacgccgaaggccaaaagagggacagcucaaaucauggaggugaccgccaaguggcuguggggauuccuuagccggaacaagaaacccagaauuuguacccgggaagaguuuacacgcaagguuagaucuaaugcugccaucggcgccguguucgucgacgaaaaccaguggaauagcgcgaaagaggcuguggaggaugaacgguuuugggaccugguucaucgcgagagagaacuccacaagcaggggaaaugcgccacgugcguguacaacaugaugggaaagcgggagaagaaacugggcgaguucgggaaggccaaaggcucccgcgcuauuugguacauguggcugggagccagauuucucgaguucgaggcucugggcuucaugaaugaagaucacugguuuucucgggagaacagccuuuccggggucgaaggagagggccugcauaagcucggguauauccugcgcgacauuucuaaaaucccuggaggcaauauguacgccgaugacaccgcggggugggauacaagaaucaccgaggacgaucuucagaacgaagcccggauuacagacaucauggagcccgaacacgcucugcucgccaagagcauuuucaaacugaccuaucaaaauaaggugguccgcgugcagagaccugcuaagaacggcacaguuauggaugugaucucccggcgcgaccagagaggaucuggccaggucgggaccuacggacugaauacguuuaccaacauggaggcccaacucauucggcagauggaaagcgagggcaucuucucccccagcgagcuggaaacaccgaaccuugcggagagagugcuggauuggcucgaaaaauaugggguggagcgccugaagcggauggccaucucuggagacgacuguguugugaaaccuauugaugacagauuugcuaccgcccuuacagcucugaaugauaugggcaagguccgcaaagacaucccccagugggaaccuuccaagggguggaacgauuggcagcaagugcccuucugcagccaucacuuucaccagcucauuaugaaggacggccgggagaucguugugccuuguagaaaucaggaugagcuggucggacgcgcccgggugucucagggcgcuggguggucccugagagaaaccgccugccucggaaaaagcuacgcgcaaauguggcagcugauguauuuccaucgccgggaccuuagacuggccgcuaacgccauuuguuccgccguccccguggauuggaucccgacgucucgcacaaccuggagcauucacgcucaucaccaguggaugacaaccgaggacaugcucuccguuuggaaucggguguggaucgaagagaacccuuggauggaagauaagacgcauaucagcucuuggggcgacguccccuaccuggggaaaagagaggaccaauggugcggaucccuuauuggccugaccgcccgggcgacaugggcuaccaauauccagguggccauuaaccagguuagacgccucaucgggaaugagaacuaccuggauuauaugacaagcaugaagcgguuuaaaaaugaaucugaccccgagggcgcccugugguga

SEQ ID NO: 18535 - RNA, 9879 nt, Artificial Sequence
  derived and/or modified CDS sequence (opt5) from DENV-1__GQ868635__SS-prME
agcgugaccaugcugcucaugcugaugcccaccgcccuugcuuuccaccugacgacccggggaggggaaccucauaugaucguguccaagcaggaacggggaaaaucucuccuguuuaagacaagcgccggcguuaacaugugcacccuuaucgccauggaccugggggaacucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugauggcccuuuuucuggcgcaugccaucgggacaucuauuacccagaagggaaucaucuucauucuccugaugcuugucaccccuagcauggcuaugagaugcgugggcaucgggucccgggauuuuguugagggacugagcggcgccacauggguggacgucgugcucgagcacgggucuugugugacgaccauggcuaaggauaaacccacacuggacauugaacugcucaagaccgaggucacaaacccugccauccugcgcaaacuuugcauugaagcgaagaucuccaauaccacgacagauagcagauguccgacccaaggagaggccacccugguugaagaacaggacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuaucgugacgguccacaccggcgaccagcaucaaguggggaaugagagcacagaacacggaaccacagcuaccauuacgccccaggccccuaccacagagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucggggcugccuacggagugcucuuuuccggcgugagcuggaccaugaagaucgggauuggcguccugcuuacguggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuucguuacaaaugaggugcacaccuggacagaacaauauaaguuucaggcggacuccccuaaacggcugucugccgcuauuggcaaggccugggaggagggggucugcggcaucagaagcgcuacccgccucgaaaacaucauguggaaacagauuuccaacgagcugaaucauauccuucuggaaaacgacaugaaguucacggugguugugggagaugucgccggcauucucgcccaggggaaaaagaugauccggccgcaacccauggaguacaaauauucuuggaaaagcuggggaaaggcuaagauuaucggcgcggacgugcagaauacaaccuuuaucauugaugggccuaacacccccgaauguccugacgaucagagagccuggaauaucugggagguggaggacuacggauucggcauuuuuacaaccaacaucuggcugaagcugcgcgauuccuauacgcaggucugcgaccaccggcuuaugagcgcugccauuaaagauucuaaggccguucacgcugacaugggcuacuggaucgaauccgagaaaaaugaaacauggaagcucgccagagcgagcuucaucgaggugaagaccuguauuuggcccaaaucucauacacugugguccaacggggugcuggaaagcgagaugaucauuccgaagaucuauggaggcccuauuucucaacacaauuaccgccccggguacuucacccagacagcuggaccuuggcaucucggcaaacuggagcuugauuuugaccugugcgaagggaccacggucgugguugaugagcacugcggaaaccggggccccagccucagaaccacaaccgugacaggcaagaucauccacgaaugguguugccgguccuguacccugccuccccugcgcuucagaggggaggacggaugcugguauggcauggagauucggccggucaaagaaaaggaggaaaaucuugucaagagcaugguuucugccggguccggagagguggacagcuuuucccucggccugcuguguaucucuauuaugaucgaagaggucaugagaagccgcuggucccggaaaaugcucaugacggggacacuggccguguuccuucugcucauuaugggacagcugaccuggaacgaucugaucagacuuugcauuaugguuggcgcuaaugccucugaccgcaugggcauggggacaaccuaccuggcgcucauggcuaccuuuaagaugagaccuauguucgccgugggacugcucuuucggcgccugacaagcagagagguccuucugcucacgaucggccugucccugguggccucuguggaacuucccaacagccuggaggaacucggggauggacuggcuaugggcaucaugauucucaaacugcuuaccgacuuccaaucccaucagcugugggccacacuccugagccugaccuuuaucaagacaaccuucucucuucacuaugcuuggaaaacgauggccaugguccuguccauuguuagccucuuuccccugugucucucuacaaccucccagaagaccacauggcugccugugcuucuggggagccugggaugcaagccgcucaccauguuccugaucgcggagaauaaaauuuggggccggcgcucuuggccccuuaacgaaggcaucauggccguggggaucgucuccauucugcucagcucccugcucaagaacgaugugccucuggcuggaccccuuaucgccggcgggaugcugauugcuuguuacguuaucagcggaucuagcgccgaccugucccucgagaaagccgcugaggugucuugggaagaggaagcggagcauagcggcgccucccacaauauucuggucgaagugcaggaugacgggacaaugaagaucaaagaugaggagagagacgauacgcuuaccauccugcucaaggcuacacugcucgccguuucuggaguguauccucugagcauucccgccacccuuuuugucugguacuucuggcagaagaagaagcagcgguccggcgugcugugggacacaccuucucccccggaagucgagaaagcugugcuggaugacggcaucuaucgcauuaugcagagagggcuccugggacggagccagguuggcgugggggucuuccaagaaaacguguuucauaccauguggcacguuacgcgcggagccgugcuuauguaccagggcaagagacuggagccuuccugggcgagcgucaaaaaggaccucaucucuuacgggggaggcuggcggcugcagggcuccuggaauaccggggaggaagugcaagugauugcuguugagcccggcaaaaacccuaagaauguccaaacagcccccggcaccuucaagacaccggaaggggaggugggagccaucgcucucgauuuuaaaccuggcaccagcgggucucccauugugaacagagaaggaaagaucgucggccuguauggcaauggggugguuacaacguccggaaccuacgugagcgccaucgcgcaggcuaaagccucccaggagggcccucuucccgagauugaagacgaggucuuccgcaagcggaaccugacaaucauggaucugcaccccgggucuggaaaaaccagacgcuaucucccugccauugugcgggaagcuaucaagagaaagcugcgcacccuuauucuggccccgacacggguuguggcuagcgagauggccgaagcgcucaaaggcaugcccaucagauaccaaacgaccgccgucaaguccgagcauacagggaaagagaucguggaccugaugugccacgcuaccuuuacaaugcgccugcucagcccuguucgggugcccaauuauaacaugauuaucauggaugaagcccauuucaccgacccuucuuccauugcugccagaggcuacaucagcacgcgggucggaaugggcgaggccgcugcgauuuuuaugacagccacacccccugggucuguggaggcuuucccgcagagcaaugccgugauccaggaugaggaacgcgacauccccgagagauccuggaacucuggauaugaguggauuaccgauuuuccuggcaagacagucugguucguucccagcaucaaauccgggaaugacauugccaacugucuucggaagaauggaaagcgcgugauccagcugucuagaaaaaccuuugauacagaauaccaaaagaccaaaaacaacgacugggacuacguggucacgacagauauuagcgagaugggcgcuaauuuccgggccgacagagugaucgauccucgccggugccugaagcccguuauucucaaagacgggccggaaagagugauccuggcgggcccuaugcccgucaccguggcuuccgccgcccagcgccggggaagaaucggccgcaaccacaauaaggagggggaucaguauauuuacaugggacagccccuuaacaaugacgaggaucaugcucacuggacagaagccaagaugcugcucgacaacaucaauaccccugagggcauuauccccgcgcuguucgaaccugagcgggagaaaagcgccgcuauugauggggaguauagacugcgcggagaggccagaaagacguuuguugaacucaugcggcgcggcgaccuuccgguguggcugucuuacaaagucgcuuccgagggguuccaauauagcgauagacgguggugcuuugacggcgaacgcaacaaucaggugcuggaggaaaacauggaugucgagaucuggaccaaggagggagaacgcaaaaagcuccggcccagauggcuggacgcccgcacauacuccgacccucuugcucugcgggaguucaaagaauuugccgcgggcagacgcucugugagcggggaucucauccuggagauuggaaagcugccccagcaccucacccagcgggcccaaaaugcucuugacaaccugguuaugcugcauaauuccgaacagggcgggagagccuaucggcacgcuauggaggagcucccugauacaaucgaaacccugaugcuucuggcccucauugccgugcugacaggaggcgugacccuguucuuucucucuggccgcgggcuuggaaagacgagcaucggccugcugugugucauggcuuccagcguucuccuguggauggcgucuguggagccccauuggauugccgcuuccaucauccuugaguucuuucugauggugcuccugauuccggagccugacagacagcggacaccccaggauaaccaacuggccuacgucgugaucgggcuccuuuucaugauucugaccguugccgcuaaugagaugggacugcucgaaaccaccaaaaaggaccugggcaucgggcacguggccgucggaaaccaccaucacgcggccaugcuugauguggaccugcauccugcuagcgccuggacccucuacgcugucgccacaacgauuaucacccccaugaugcgccacacaauugagaacaccacagcgaauaucucucugaccgccaucgcuaaccaggccgcuauucugaugggccucgauaaaggcuggccuaucuccaagauggacauuggggugccccuucuggcccugggaugcuauagccagguuaauccgcucacgcugaccgcugccgugcuuaugcuggucgcgcauuacgccaucauuggcccugggcuccaagcuaaagccacaagagaagcucagaagcggaccgccgccggaaucaugaagaaccccacaguggauggcaucguugcgauugaccuggaucccguggucuaugacgcuaaauuugagaagcagcuggggcagaucaugcuccuuauucuguguaccucucaaauccugcucaugcgcacgacaugggcccugugcgaaagcauuacccuugcuacaggaccucugaccacccucugggagggcuccccgggcaaauucuggaauacaacgaucgccgugucuauggccaacaucuuuagagggagcuaccuggcuggagccggccuggcguucucccucaugaaaagccuugggggaggccggcgcgggaccggagcccagggcgagacacugggcgaaaaauggaagagacagcugaaucagcucuccaagucugaguucaacaccuauaaacggagcgggauuauggaaguggacagauccgaggcuaaggaaggacugaaacgcggcgagacaaccaagcacgccguuucucgggggacggcuaaacuuagaugguuugucgagcgcaaucuggugaagcccgaaggaaaggugaucgaucucggcugugggcggggaggcuggagcuacuauugcgccggccugaaaaaggucacagagguuaaaggguacaccaagggaggcccugggcacgaagaacccauuccuauggcgaccuacggauggaaccuggugaaacuccauuccggcaaggacguguucuuuauucccccugaaaaaugugauacacuucugugcgacauuggggagucuagcccgaaucccaccaucgaggaaggaagaacacugcgcguccucaagaugguggagccuuggcugcggggcaaccaauucuguauuaagauccuuaaucccuauaugccuuccguuguggaaacgcuggagcagaugcagagaaaacacggcgggaugcucguccgcaacccccugagcagaaauucuacccaugagauguacuggguguccugcggaacaggcaacaucguuagcgccgugaauaugaccucuagaaugcugcucaaccgcuuuacaauggcucaccggaagccgaccuaugaaagagaugucgaccugggggccggaacgcgccacguggcuguggagccugaagucgccaaccuugauauuaucggccagagaauugagaauaucaaacaugaacacaaguccaccuggcauuacgacgaggauaaccccuauaaaacaugggcuuaccacgggagcuaugagguuaagcccucuggauccgccagcuccauggugaauggcguggucaagcugcucaccaaaccuugggacgugauucccaugguuacacaaaucgcgaugaccgauacaaccccuuucggccagcagcggguguuuaaggaaaaagucgacacgcgcacaccgaaggccaaaagagggaccgcucaaaucauggaggugaccgccaaguggcuguggggauuccuuagccggaacaagaaacccagaauuuguacacgggaagaguuuacgcgcaagguuagaucuaaugcugccaucggcgccguguucgucgacgaaaaccaguggaauagcgcgaaagaggcuguggaggaugaacgguuuugggaccugguucaucgcgagagagaacuccacaagcaggggaaaugcgcgaccugcguguacaacaugaugggaaagcgggagaagaaacugggcgaguucgggaaggccaaaggcucccgcgcuauuugguacauguggcugggagccagauuucucgaguucgaggcucugggcuucaugaaugaagaucacugguuuucucgggagaacagccuuuccggggucgaaggagagggccugcauaagcucggguauauccugcgcgacauuucuaaaaucccuggaggcaauauguacgccgaugacacagcggggugggauaccagaaucacagaggacgaucuucagaacgaagcccggauuaccgacaucauggagcccgaacacgcucugcucgccaagagcauuuucaaacugacauaucaaaauaaggugguccgcgugcagagaccugcuaagaacggcaccguuauggaugugaucucccggcgcgaccagagaggaucuggccaggucgggacguacggacugaauaccuuuacaaacauggaggcccaacucauucggcagauggaaagcgagggcaucuucucccccagcgagcuggaaaccccgaaccuugcggagagagugcuggauuggcucgaaaaauaugggguggagcgccugaagcggauggccaucucuggagacgacuguguugugaaaccuauugaugacagauuugcuacagcccuuaccgcucugaaugauaugggcaagguccgcaaagacaucccccagugggaaccuuccaagggguggaacgauuggcagcaagugcccuucugcagccaucacuuucaccagcucauuaugaaggacggccgggagaucguugugccuuguagaaaucaggaugagcuggucggacgcgcccgggugucucagggcgcuggguggucccugagagaaacggccugccucggaaaaagcuacgcgcaaauguggcagcugauguauuuccaucgccgggaccuuagacuggccgcuaacgccauuuguuccgccguccccguggauuggaucccgacaucucgcaccacauggagcauucacgcucaucaccaguggaugaccacggaggacaugcucuccguuuggaaucggguguggaucgaagagaacccuuggauggaagauaagacccauaucagcucuuggggcgacguccccuaccuggggaaaagagaggaccaauggugcggaucccuuauuggccugacagcccgggcgaccugggcuacaaauauccagguggccauuaaccagguuagacgccucaucgggaaugagaacuaccuggauuauaugaccagcaugaagcgguuuaaaaaugaaucugaccccgagggcgcccugugguga

SEQ ID NO: 18536 - RNA, 9879 nt, Artificial Sequence
  derived and/or modified CDS sequence (opt5) from DENV-1__GQ868636__SS-prME
uccgugaccaugcugcucaugcugaugcccaccgcccuugcuuuccaccugacgaccagaggcggggaaccucauaugaucgucacaaagcaggaacggggaaagucccuucuguuuaagaccucugccggcguuaauaugugcacccuuauugcgauggaccugggggaacucugugaagauaccaugacauacaagugcccgcgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcggggcucggagaggucgacuccuuuagccugggccugcucuguaucuccauuaugaucgaagaggugaugcggucuagauggagccgcaagaugcugauggcugggacacuugccguuuuccugcuccugauuaugggacagcugaccuggaacgaucuuauccggcugugcauuauggugggcgccaaugcuuccgacagaaugggcauggggacaaccuaucucgcccugauggcgaccuuuaaaaugcgcccuauguucgcugucggacuccuguuuagacggcuuacaucucgcgaggugcugcuccugacgaucggccugagccuuguggccuccgucgaacugcccaacucucucgaggaacugggggauggacucgccaugggcaucaugauucugaaacuucugaccgacuuccaaagccaccagcucugggcuacacugcugucccuuaccuuuaucaaaacaacccugagccuccaucacgccuggaagacgauggcuaugguucugucuauugugucccucuucccccugugucuuagcacaaccucucagaagaccacauggcugccugugcugcucgggucccugggaugcaaaccgcuuaccauguuucugaucgccgagaauaagauuuggggcagaaaaagcuggccccucaacgaaggcaucauggcggucggggugguuucuauccugcucuccagccugcuuaagaacgaugugccucuggccggaccccugauugcuggcgggaugcucaucgccuguuacgucauuuccggaagcucugcugaccugagccuugagaaagccgccgagguguccugggaagaggaagcugagcauucuggcgcgagccacaauauccugguugaagugcaggaugacgggacaaugaagauuaaagaugaggagcgggacgauacgcucaccauccugcucaaggccacacugcuugcuaucuccggagucuauccucugucuauucccgccacccuguucgugugguacuuuuggcaaaagaaaaagcagcgcagcggcguccucugggacacaccuagcccucccgaaguggagagagccguucuggaugacggcaucuaucggauuaugcagcgcgggcuucugggaagaucucaggugggcgucgggguguuccaagaaaacguuuuccacaccauguggcaugugacgcggggagcuguccucauguaccagggcaaacgccuggagcccagcugggccuccgugaagaaagaccucaucagcuaugggggaggcuggagacugcagggcucuuggaauaccggggaggaagugcagguuauugcggucgagcccggaaagaacccuaagaaugugcaaacagcucccggcaccuuuaaaacaccggaaggggaggugggagccaucgcccuugauuucaagccuggcaccuccgggagccccauugucaaccgggaaggaaaaaucgugggccuguacggcaaugggguugugacaacgucuggaaccuacgucuccgcuaucgcccaggcgaaggcuagccaggagggcccucugcccgagauugaagacgagguguuuagaaaacgcaaccucacaaucauggaucugcaccccggguccggaaagacccggagauaucuuccugccauuguucgcgaagccaucaagcggaaacugagaacccucauucuggcuccgacacgcguggucgccucugagauggcugaagcccugaagggcaugcccauccgguaccaaacgaccgcggugaaaagcgagcauacagggaaggagaucguugaccucaugugccacgccaccuucacaaugagacuucuguccccugugcgcguccccaauuauaacaugauuaucauggaugaagcucauuuuaccgacccuagcucuauugccgcucggggcuacaucuccacgagagugggaaugggcgaggccgccgcuauuuucaugacagcgacacccccugggagcguggaagccuuuccgcagucuaaugcugucauccaggaugaggaacgggacauccccgagcgcagcuggaacuccggauaugaguggauuaccgauuucccuggcaaaacaguuugguuugugcccucuaucaagagcgggaaugacauugccaacugucugagaaagaauggaaaacgggugauccagcucucccgcaagaccuucgauacagaauaccagaagaccaagaacaacgacugggacuaugucgugacgacagauauuucugagaugggcgccaauuuuagagcugaccggguuaucgauccuagacgcugccugaaacccgugauucuuaaggacgggccggaacgggucauccuggccggcccuaugcccgugaccguugcgagcgcugcccagagacgcggacggaucggcagaaaccacaauaaggagggggaucaguacauuuacaugggacagccccucaacaaugacgaggaucacgcccauuggacagaagcuaaaaugcugcuggacaacaucaauaccccugagggcauuauccccgcccucuucgaaccugagcgcgaaaaguccgcggccauugauggggaguaucggcuuagaggagaggcucgcaaaacguucguggaacugaugagacggggcgaccugccggucuggcucagcuacaagguggccucugagggguuucaauauuccgaucgcagauggugcuucgacggcgaacggaacaaucagguccuggaggaaaacauggauguggagaucuggaccaaagagggagaacgcaagaaacuuagaccccgguggcuggacgcuagaacauacagcgacccucucgcccugcgcgaguuuaaggaguucgcugccggccggagauccguuucuggggaucugauccucgagauuggaaaacuuccccagcaccugacccagcgcgcgcaaaaugcccuggacaaccucgugaugcugcauaauagcgaacagggcgggcgggcuuauagacacgccauggaggagcuuccugauacaaucgaaacccugaugcuccuggcucugauugccgugcucacaggaggcgucacccucuuuuuccuguccggccgggggcugggaaaaacgucuaucggccuccuguguguuauggccagcuccgugcuucuguggauggcuagcguggagccccacuggauugcggccucuaucauccucgaauuuuuccugaugguccugcucauuccggagccugaccgccagagaacaccccaggauaaccaacuugcuuacgugguuaucgggcugcuguuuaugauucucaccguggccgccaaugagaugggacugcuugaaaccacaaagaaagaccugggcaucgggcaugucgcuguggagaaccaccaucacgccaccaugcucgaugucgaccugcauccugcguccgccuggacacuguaugcuguggccacgaccauuaucacacccaugaugcggcacaccauugaaaacacaaccgcuaauaucagccucacggccaucgcgaaccaggccgcuauucuuaugggacuggauaagggcuggccuaucucuaaaauggacauuggcguuccccugcucgcccuggggugcuacucccaggugaauccgcuuacccugacagcugccguccucaugcugguggcucacuacgccaucauuggaccuggccugcaagcgaaggccacccgcgaggcucagaagagaacagccgcugggaucaugaaaaaccccaccguugauggaaucguggccauugaccucgaucccgucguguaugacgccaaguucgaaaaacagcuuggccagaucaugcugcugauucucuguacgagccaaauccugcuuaugcggacaaccugggcgcugugcgagucuauuacacucgcuaccgggccucugaccacacugugggagggaagcccgggcaaguuuuggaauacgaccaucgccguguccauggcuaacaucuuccgcggcucuuaccucgccggggccggacuugcuuuuagccugaugaaaucccugggcgggggaagacggggcacaggggcccagggagaaacccucggcgagaaguggaagcgccagcugaaucagcuuagcaaauccgaguucaacauuuauaagagaucuggcaucauggagguugaccggagcgaagcgaaagaggggcugaagagaggagagacaacccgccaugccgucucccggggcacggcuaaacucagaugguucguggaacgcaaucuggugaagcccgaggggaaggucauugaucugggauguggcagagggggauggucuuacuauugcgccggccucaaaaagguuacagaagugaaaggcuacaccaaagggggaccuggccacgaggaacccaucccuauggcuaccuauggguggaaccuugugaaacugcauagcggaaaggacgucuuuuucacacccccugagagaugugauacccugcucugcgacauuggcgaguccucuccgaaucccacaaucgaagaggggcgcacgcugcgggugcuuaaaaugguugaaccuuggcugagaggaaaccaauuuuguauuaagauccucaaucccuacaugccuagcguggucgagacccuggagcagaugcagcgcaagcacggcggcaugcuggugcggaacccccucuccagaaauagcacacacgaaauguacuggguuucuugcgggaccggaaacaucguguccgccgucaauaugacaagccgcaugcugcuuaaccgguucaccauggcgcauagaaaaccgacguaugagcgcgauguggaccugggcgccgggaccagacacguggcugucgaaccugagguugccaaccucgauauuaucggacagcggauugaaaauaucaagcaugagcacaaaucuacauggcauuacgacgaggauaaccccuauaagaccugggcuuaccacggcuccuaugaagugaaacccagcgggucugccuccagcauggugaauggagucgugaagcugcuuacaaagccuugggacguuauucccauggugacccaaaucgcuaugacagauaccacgccuuuuggccagcagcgcgucuucaaagagaagguggacacaagaaccccgaaagccaagcggggcaccgcgcaaaucauggaaguuacagccagauggcuguggggguuucucucccggaacaaaaagccccgcauuuguacgagagaggaguucacccggaaggugcgcagcaaugcugccaucggagcugucuuuguggacgagaaccaguggaacucugccaaagaggccguugaagaugagagauucugggaccuggugcagaaggaacgggagcugcacaaacagggcaagugcgcgacaugcgucuacaacaugauggggaaacgcgaaaagaagcucggagaguuuggcaaagcuaaggggagcagagccauuugguauauguggcugggcgcccgguuccuugaguuugaagcucugggauucaugaaugaggaucauugguucucccgcgaaaacucucucagcggcguggagggggagggacugcacaaacuuggcuacauccugagagacauuuccaagaucccugggggaaauauguacgccgaugacaccgcuggcugggauacacggaucaccgaagacgaucuccaaaacgaggccaaaauuacagacaucauggaacccgagcaugcgcugcuggccaccucuauuuuuaagcucacguaucagaauaaagucgugcgcguucagagaccugcuaagaacgggaccgugauggaugucaucagccggcgcgaccagagaggcuccggacaagugggcacauacgggcugaauaccuucacaaacauggaagcccagcuuauucggcagauggagucugagggaaucuuucugcccagcgaacucgagaccccgaaccuggcugaaagagugcuugauuggcuggagaagcacggcguugaacgccucaaacggauggccaucuccggggacgacuguguggucaagccuauugaugacagauucgcgacggcccugacagcucugaaugauaugggaaaagugcgcaaggacaucccccagugggagccuagcaaaggcuggaacgauuggcaacagguucccuuuugcucucaccauuuccaccagcucauuaugaaggacgggcgggagaucguggucccuuguagaaaucaggaugaacuggugggccgcgcccgggucucccaaggagcuggcuggagccuuagagagaccgccugccuggggaagucuuaugcucagauguggcagcucauguacuuucaucgccgggaccugagacuugccgcgaacgccauuuguuccgcugugcccguugauugggugccgacaagccgcaccacgugguccauccacgcccaucaccaauggaugaccacagaagacaugcugucugucuggaaucggguguggauugaggaaaacccuuggauggaggauaaaacccacguuagcuccuggggagacgugcccuaucucggcaagagagaggaccaguggugcgggagccugaucggacugacagcccgggcuaccugggccucuaauauccaggucgcgauuaaccaggugagacgccucaucggcaaugaaaacuaccuggauuauaugacauccaugaaacgguucaagaaugagggggaccccgaaggcgcucuuugguga

SEQ ID NO: 18537 - RNA, 9879 nt, Artificial Sequence
  derived and/or modified CDS sequence (opt5) from DENV-1__GU131922__SS-prME
agcgugaucaugcugcucaugcugaugcccaccgcccuugcuuuccaccugacaacgagaggcggggagccucauaugaucguguccaagcaggaacggggaaaaucucuccuguuuaagaccagcgccggcguuaacaugugcacccuuaucgcgauggaccugggggagcucugugaagauaccaugacauacaaaugcccccgcauuaccgaggcugaacccgacgauguggacuguuggugcaaugccacagauaccugggugacguauggaaccuguucccaaacaggcgagcacagacgggacaagcgcucuguggcccuggcuccucauguggggcugggacucgagaccagaacagaaaccuggaugagcuccgagggcgccuggaaacagauccagcggguugaaacgugggcucugcgccaccccggcuucacagugauugcccuuuuucuggcgcaugccaucgggaccucuaucacacagaagggaauuaucuucauucuccugaugcuugucaccccuagcauggcuaugagaugcgugggcaucgggucccgggauuuuguugagggacugagcggcgccaccuggguggacgucgugcucgagcacgggucuugugugacaacgauggcuaaggauaaacccacccuggacauugaacugcucaagacagaggucaccaacccugccauccugcgcaaacuuugcauugaagcgaagaucuccaauacaaccacggauagcagauguccgacacaaggagaggccacccugguugaagaacaagacgcuaacuucgugugccggcgcaccuuuguggauagaggcuggggcaauggguguggacucuucggcaaagggucucugaucacaugcgccaaguuuaagugcgucaccaaacuugagggaaagauugugcaguacgaaaaccugaaauauuccguuaucgugacaguccacacgggcgaccagcaucaaguggggaaugagagcaccgaacacggaacaaccgcuacaauuacgccccaagccccuaccaccgagauccagcucacagacuacggcgcccugacccuggauuguucuccccggacaggccucgacuucaacgaaaugguucugcuuaccaugaaggagaaauccuggcuggugcauaagcagugguuucucgaucugccucuucccuggacgagcggggcuuccacaucucaagagaccuggaaucgccaggaccugcucgucacauucaaaaccgcgcacgccaagaagcaggaaguggucgugcugggaagccaagagggcgcuaugcacaccgcccugacaggggccacggaaauucagaccuccggaacaaccacaaucuuugcuggccaucucaaaugcagacugaagauggauaaacuuacccugaaggggaugagcuauguuauguguacgggcucuuucaaacucgagaaggaaguggccgagacacagcacggaaccguccuggugcagaucaaguacgagggcaccgacgcgccgugcaaaauuccuuucuccacacaagaugaaaaggggguuacccagaacggacggcugaucacagcuaaucccauugugacggacaaagagaagccugucaacaucgaagccgagccgcccuuuggcgagagcuauauugugaucggggccggagaaaaagcucuuaagcucucuugguucaagaaaggcagcuccaucgggaagauguuugaggccaccgcuagaggcgcccgccggauggcgauucugggagauacagccugggacuucggcucuaucgggggaguguuuaccagcguuggcaaacugguccaucagauuuucgggacagcuuacggagugcucuuuuccggcgugagcuggaccaugaagaucgggauuggcguccugcuuacguggcugggacucaauucuagauccaccagccugucuaugacauguaucgccgugggccugguuacccuuuaccucggggugaugguccaggcugauuccggaugcgugauuaacuggaaaggccgcgaacugaagugugggagcggaaucuucguuacaaaugaggugcacaccuggacagaacaauauaaguuucaggccgacuccccuaaacggcugucugcggccaucggcaaggcuugggaggagggggucugcggcauuagaagcgccacccgccucgaaaacaucauguggaaacagauuuccaacgagcugaaucauauccuucuggaaaacgacaugaaguucacggugguugugggagaugucgcuggcauucucgcccaggggaaaaagaugauccggccgcaacccauggaguacaaauauucuuggaaaagcuggggaaaggccaagaucauuggcgcugacgugcagaauacaaccuuuaucauugaugggccuaacacccccgaauguccugacgaucagagagcguggaauaucugggagguggaggacuacggauucggcauuuuuacaaccaacaucuggcugaagcugcgcgauuccuauacgcaggucugcgaccaccggcuuaugagcgccgcuaucaaagauucuaaggccguucacgccgacaugggcuacuggauugaauccgagaaaaaugaaacauggaagcucgcuagagccagcuucaucgaggugaagaccuguauuuggcccaaaucucauacacugugguccaacggggugcuggaaagcgagaugaucauuccgaagaucuauggaggcccuaucucucaacacaauuaccgccccggguacuucacccagacagcgggaccuuggcaucucggcaaacuggagcuugauuuugaccugugcgaagggaccacggucgugguugaugagcacugcggaaaccggggccccagccucagaaccacaaccgugacaggcaagauuauccacgaaugguguugccgguccuguacccugccuccccugcgcuucagaggggaggacggaugcugguauggcauggagauucggccggucaaagaaaaggaggaaaaucuugucaagagcaugguuucugcuggguccggagagguggacagcuuuucccucggccugcuguguaucucuauuaugaucgaagaggucaugagaagccgcuggucccggaaaaugcucaugacggggacacuggccguguuccuucugcucauuaugggacagcugaccuggaacgaucugaucagacuuugcaucaugguuggcgccaaugcuucugaccgcaugggcauggggacaaccuaccuggcccucauggcgaccuuuaagaugagaccuauguucgcugugggacugcucuuucggcgccugacaagcagagagguccuucugcucacgauuggccugucccugguggccucuguggaacuucccaacagccuggaggaacucggggauggacuggccaugggcaucaugauucucaaacugcuuaccgacuuccaaucccaucagcugugggcuacacuccugagccugaccuuuaucaagacaaccuucucucuucacuaugccuggaaaacgauggcuaugguccuguccauuguuagccucuuuccccugugucucucuacaaccucccagaagaccacauggcugccugugcuucuggggagccugggaugcaagccgcucaccauguuccugaucgccgagaauaaaaucuggggccggcgcucuuggccccuuaacgaaggcauuauggcgguggggaucgucuccauucugcucagcucccugcucaagaacgaugugccucuggccggaccccuuaucgcuggcgggaugcugauugccuguuacguuaucagcggaucuagcgcugaccugucccucgagaaagccgccgaggugucuugggaagaggaagcugagcauagcggcgcgucccacaauauccuggucgaagugcaggaugacgggacaaugaagauuaaagaugaggagagagacgauacgcuuaccauccugcucaaggccacacugcucgcuguuucuggaguguauccucugagcauucccgccacccuuuuugucugguacuucuggcagaagaagaagcagcgguccggcgugcugugggacacaccuucucccccggaagucgagcgcgccgugcuggaugacggcaucuauagaauuaugcagcgggggcuccugggacgcagccagguuggcgugggggucuuccaagaaaacguguuucauaccauguggcacguuacgagaggagcugugcuuauguaccagggcaaacggcuggagccuuccugggccagcgucaagaaagaccucaucucuuacgggggaggcuggagacugcagggcuccuggaauaccggggaggaaguccaggugauugcgguugagcccggaaagaacccuaaaaauguccaaacagcucccggcaccuucaagacaccggaaggggaggugggagccaucgcccucgauuuuaagccuggcaccagcgggucucccaucgugaaccgcgaaggaaaaauugucggccuguauggcaauggggugguuacaacguccggaaccuacgugagcgcuaucgcccaggcgaaggcuucccaggagggcccucuucccgagauugaagacgaggucuuccggaaaagaaaccugacaaucauggaucugcaccccgggucuggaaagacccgccgguaucucccugccauugugagagaagccaucaaacgcaagcugcggacccuuauccuggcuccgacaagaguuguggccagcgagauggcugaagcccucaagggcaugcccauucgcuaccaaacgaccgcggucaaauccgagcauacagggaaggagaucguggaccugaugugccacgccaccuuuacaaugcggcugcucagcccuguuagagugcccaauuauaacaugauuaucauggaugaagcucauuucaccgacccuucuuccauugccgcucggggcuacaucagcacgcgcgucggaaugggcgaggccgccgcuaucuuuaugacagcgacacccccugggucuguggaagccuucccgcagagcaaugcugugauucaggaugaggaaagagacauccccgagcgguccuggaacucuggauaugaguggauuaccgauuuuccuggcaaaacagucugguucguucccagcaucaaguccgggaaugacauugccaacugucuucgcaaaaauggaaagagagugauccagcugucucggaagaccuuugauacagaauaccagaaaaccaagaacaacgacugggacuacguggucacgacagauauuagcgagaugggcgccaauuucagagcugaccgcgugaucgauccucggagaugccugaaacccguuauccucaaggacgggccggaacgcgugauucuggccggcccuaugcccgucaccguggcguccgcugcccagcggagaggacgcaucggccggaaccacaauaaagagggggaucaguauauuuacaugggacagccccuuaacaaugacgaggaucaugcccacuggacagaagcuaagaugcugcucgacaacaucaauaccccugagggcauuauccccgcccuguucgaaccugagagagaaaagagcgcggccaucgauggggaguaucgccugagaggagaggcucggaaaacguuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagauuuggaccaaagagggagaacggaagaaacucagaccccgcuggcuggacgcucggacauacuccgacccucuugcccugagagaguucaaggaauuugcugccggccgccggucugugagcggggaucucauccuggagauuggaaaacugccccagcaccucacccagagagcgcaaaaugcccuugacaaccugguuaugcugcauaauuccgaacagggcgggcgggcuuaucgccacgccauggaggagcucccugauacaaucgaaacccugaugcuucuggcucucauugccgugcugacaggaggcgugacccuguucuuucucucuggcagagggcuuggaaagacgagcaucggccugcugugugucauggccuccagcguucuccuguggauggcuucuguggagccccauuggaucgcggccuccauuauccuugaguucuuucugauggugcuccugauuccggagccugaccggcagcgcacaccccaggauaaccaacuggcuuacgucgugaucgggcuccuuuucaugauucugaccguugccgccaaugagaugggacugcucgaaaccacaaagaaagaccugggcaucgggcacguggcugucggaaaccaccaucacgccgcgaugcuugauguggaccugcauccugccagcgcuuggacccucuacgccgucgcuacaacgauuaucacccccaugaugagacacacaaucgagaacaccacagccaauauuucucugaccgcgaucgccaaccaggcugccauucugaugggccucgauaagggcuggccuaucuccaaaauggacauuggggugccccuucuggcucugggaugcuauagccagguuaauccgcucacgcugaccgccgcugugcuuaugcuggucgcccauuacgcgaucaucggcccugggcuccaagccaaggcuacacgggaagcccagaaacgcaccgcugccggaauuaugaagaaccccacaguggauggcaucguugccauugaccuggaucccguggucuaugacgcgaaguuugagaaacagcuggggcagaucaugcuccuuauucuguguaccucucaaauccugcucaugagaacgacaugggcucugugcgaaagcaucacccuugccacaggaccucugaccacccucugggagggcuccccgggcaaguucuggaauacaacgauugcugugucuauggccaacaucuuucgggggagcuaccuggccggagcuggccuggccuucucccucaugaaaagccuugggggaggccgcagagggaccggagcgcagggcgagacacugggcgaaaaguggaaacggcagcugaaucagcucuccaagucugaguucaacaccuauaagagaagcgggauuauggaaguggaccgcuccgaggccaaagaaggacugaagcggggcgagacaaccaaacacgcuguuucuagagggacggccaaacuucgcugguuugucgagcggaaucuggugaaacccgaaggaaaggugaucgaucucggcugugggagaggaggcuggagcuacuauugcgcuggccugaagaaagucacagagguuaagggguacaccaaaggaggcccugggcacgaagaacccauuccuauggccaccuacggauggaaccuggugaagcuccauuccggcaaagacguguucuuuauucccccugaaaagugugauacacuucugugcgacauuggggagucuagcccgaaucccaccaucgaggaaggacgcacacugcggguccucaaaaugguggagccuuggcugagaggcaaccaauucuguaucaagauucuuaaucccuauaugccuuccguuguggaaacgcuggagcagaugcagcgcaagcacggcgggaugcucguccggaacccccugagcagaaauucuacccaugagauguacuggguguccugcggaacaggcaacaucguuagcgcggugaauaugaccucucgcaugcugcucaaccgguuuacaauggcccacagaaaaccgaccuaugaacgcgaugucgaccugggggcuggaacgagacacguggccguggagccugaagucgcuaaccuugauauuaucggccagcggauugagaauaucaagcaugaacacaaauccaccuggcauuacgacgaggauaaccccuauaagacaugggccuaccacgggagcuaugagguuaaacccucuggauccgcuagcuccauggugaauggcguggucaagcugcucaccaagccuugggacgugauccccaugguuacacaaauugccaugaccgauacaaccccuuucggccagcagcgcguguuuaaagaaaaggucgacacgagaacaccgaaagcgaagcgggggaccgcccaaaucauggaggugaccgcuaaauggcuguggggauuccuuagcagaaacaagaagccccggauuuguacacgcgaagaguuuacgagaaaaguucggucuaaugccgcuaucggcgccguguucgucgacgaaaaccaguggaauagcgccaaggaggcgguggaggaugaacgcuuuugggaccugguucauaaagagagagaacuccacaagcaggggaaaugcgcuaccugcguguacaacaugaugggaaagcgggagaagaaacugggcgaguucgggaaggccaaaggcucccgcgccauuugguacauguggcugggagcuagauuucucgaguucgaggcccugggcuucaugaaugaagaucacugguuuucucgggagaacagccuuuccggggucgaaggagagggccugcauaagcucggguauauccugcgcgacaucucuaaaauuccuggaggcaauauguacgcugaugacacagccgggugggauaccagaaucacagaggacgaucuucagaacgaagcgcggauuaccgacaucauggagcccgaacacgcccugcucgcuaagagcauuuucaaacugacauaucaaaauaaggugguccgcgugcagagaccugccaagaacggcaccguuauggaugugaucucccggcgcgaccagagaggaucuggccaggucgggacguacggacugaauaccuuuacaaacauggaggcucaacucauccggcagauggaaagcgagggcauuuucucccccagcgagcuggaaaccccgaaccuugccgagagagugcuggauuggcucgaaaaauaugggguggagcgccugaagcggauggcgaucucuggagacgacuguguugugaaaccuauugaugacagauuugccacagcucuuaccgcccugaaugauaugggcaagguccgcaaagacaucccccagugggaaccuuccaagggguggaacgauuggcagcaagugcccuucugcagccaucacuuucaccagcucauuaugaaggacggccgggagaucguugugccuuguagaaaucaggaugagcuggucggacgcgcucgggugucucagggcgccggguggucccugagagaaacggcuugccucggaaaaagcuacgcccaaauguggcagcugauguauuuccaucgccgggaccuuagacuggcggccaacgcuauuuguuccgccguccccguggauuggaucccgacaucucgcaccacauggagcauccacgcccaucaccaguggaugaccacggaggacaugcucuccguuuggaaucggguguggauugaagagaacccuuggauggaagauaagacccauaucagcucuuggggcgacguccccuaccuggggaaaagagaggaccaauggugcggaucccuuauuggccugacagcucgggccaccugggcgacaaauauccagguggcuauuaaccagguuagacgccucaucgggaaugagaacuaccuggauuauaugaccagcaugaagcgguuuaaaaaugaaucugaccccgagggcgcccugugguga

SEQ ID NO: 18538 - RNA, 9879 nt, Artificial Sequence
  derived and/or modified CDS sequence (opt5) from DENV-1__GU131923__SS-prME
agcgugaccaugcugcucaugcugaugcccaccgcccuugcuuuccaccugacgacccggggaggggaaccucauaugaucguguccaagcaggaacggggaaaaucucuccuguuuaagaccagcgccggcguuaacaugugcacccuuaucgcgauggaccugggggaacucugugaagauacaaugaccuacaaaugccccagaaucacagaagcugaacccgacgauguggacuguuggugcaaugccaccgauacgugggugaccuauggaacauguucccaaaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaggacgcuaacuucgugugccggcgcacaguggucgauagaggcuggggcaauggguguggacucuuuggcaaagggucucugauuaccugcgccaaguucaagugcgugacaaaacuugagggaaagaucguucaguacgaaaaccugaaauauuccgugauugucacggugcacaccggcgaccagcaucaaguugggaaugagagcacagaacacggaaccacagcuaccaucacgccccaggccccuaccacagagauucagcucaccgacuacggcgcccugacacuggauuguucuccccggaccggccucgacuuuaacgaaauggugcugcuuacgaugaaggagaaauccuggcugguccauaagcagugguuccucgaucugccucuucccuggacaagcggggcuuccaccucucaagagacauggaaucgccaggaccugcucgugaccuuuaaaaccgcgcacgccaagaagcaggaagucgugguucugggaagccaagagggcgcuaugcacacagcccugacgggggccaccgaaauccagacauccggaaccacaaccauuuucgcuggccaucucaaaugcagacugaagauggauaaacuuacgcugaaggggaugagcuaugugauguguacaggcucuuuuaaacucgagaaggaagucgccgagacccagcacggaaccgugcugguucagaucaaguacgagggcacagacgcgccgugcaaaaucccuuucuccacccaagaugaaaaggggauuacacagaacggacggcugaucacggcuaaucccauugugaccgacaaagagaagccugucaacaucgaagccgagccgcccuucggcgagagcuauauugugaucggggccggagaaaaagcucuuaagcucucuugguuuaagaaaggcagcuccaucgggaagauguucgaggccacagcuagaggcgcccgccggauggcgauucugggagauaccgccugggacuuuggcucuaucgggggaguguucacaagcguuggcaaacugguccaucagauuuuugggaccgcuuacggaguccuguucuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuuuguuaccaaugaggugcacacauggaccgaacaauauaaguuccaggccgacuccccuaaacggcugucugcggccaucggcaaggcuugggaggagggggucugcggcauuagaagcgccacgcgccucgaaaacaucauguggaaacagauuuccaacgagcugaaucauauccuucuggaaaacgacaugaaguuuacagugguugugggagaugucgcuggcauucucgcccaggggaaaaagaugauccggccgcaacccauggaguacaaauauucuuggaaaagcuggggaaaggccaagaucauuggcgcugacgugcagaauaccaccuucaucauugaugggccuaacacacccgaauguccugacgaucagagagcguggaauaucugggagguggaggacuacggauuuggcauuuucaccacgaacaucuggcugaagcugcgcgauuccuauacacaggucugcgaccaccggcuuaugagcgccgcuaucaaagauucuaaggccguucacgccgacaugggcuacuggauugaauccgagaaaaaugaaaccuggaagcucgcuagagccagcuuuaucgaggugaagacauguauuuggcccaaaucucauacccugugguccaacggggugcuggaaagcgagaugaucauuccgaagaucuauggaggcccuaucucucaacacaauuaccgccccggguacuucacacagaccgcgggaccuuggcaucucggcaaacuggagcuugauuucgaccugugcgaagggacgaccgucgugguugaugagcacugcggaaaccggggccccagccucagaacaaccacagugaccggcaagauuauccacgaaugguguugccgguccuguacgcugccuccccugcgcuuuagaggggaggacggaugcugguauggcauggagauucggccggucaaagaaaaggaggaaaaucuugugaaaagcaugguuucugcuggguccggagagguggacagcuucucccucggccugcuguguaucucuauuaugaucgaagaggucaugagaagccgcuggucccggaaaaugcucaugacagggacccuggccguguuucuucugcucauuaugggacagcugacauggaacgaucugaucagacuuugcaucaugguuggcgccaaugcuucugaccgcaugggcauggggaccaccuaccuggcccucauggcgacauucaagaugagaccuauguuugcugugggacuccucuuccggcgccugacgagcagagagguccuucugcucaccauuggccugucccugguggccucuguggaacuucccaacagccuggaggaacucggggauggacuggccaugggcaucaugauucucaaacugcuuacagacuuucaaucccaucagcugugggcuacccuccugagccugacauucaucaagaccacguuuucucuucacuaugccuggaaaacaauggcuaugguccuguccauuguuagccucuucccccugugucucucuaccaccucccagaagacaaccuggcugccugugcuucuggggagccugggaugcaagccgcucacaauguuucugaucgccgagaauaaaaucuggggcaagcggucuuggccccuuaacgaaggcauuauggcgguggggaucgucuccauucugcucagcucccugcucaaaaacgaugugccucuggccggaccccuuaucgcuggcgggaugcugauugccuguuacguuaucagcggaucuagcgcugaccugucccucgagaaggccgccgaggugucuugggaagaggaagcugagcauagcggcgcgucccacaauauccuggucgaagugcaggaugacgggacgaugaaaauuaaggaugaggagcgcgacgauacccuuacaauccugcucaaagccacccugcucgcuguuucuggaguguauccucugagcauucccgccacacuuuucgucugguacuuuuggcaaaagaagaaacagagauccggcgugcugugggacaccccuucucccccggaagucgagcgggccgugcuggaugacggcaucuaucgcauuaugcagagagggcuccugggacggagccagguuggcgugggggucuuccaagaaaacguguuccauacgauguggcacguuacccgcggagcugugcuuauguaccagggcaagagacuggagccuuccugggccagcgucaaaaaggaccucaucucuuacgggggaggcuggcggcugcagggcuccuggaauacaggggaggaaguccaggugauugcgguugagcccggcaagaacccuaagaauguccaaaccgcucccggcacauuuaagaccccggaaggggaggugggagccaucgcccucgauuucaaaccuggcacaagcgggucucccaucgugaacagagaaggaaagauugucggccuguauggcaauggggugguuacgaccuccggaacauacgugagcgcuaucgcccaggcgaaggcuucccaggagggcccucuucccgagauugaagacgaggucuuucgcaagcggaaccugaccaucauggaucugcaccccgggucuggaaaaaccagacgcuaucucccugccauugugcgggaagccaucaagagaaagcugcgcacacuuauccuggcuccgacgcggguuguggccagcgagauggcugaagcccucaaaggcaugcccauuagauaccaaaccacagcggucaaguccgagcauaccgggaaagagaucguggaccugaugugccacgccacauucaccaugcgccugcucagcccuguucgggugcccaauuauaacaugauuaucauggaugaagcucauuuuacggacccuucuuccauugccgcuagaggcuacaucagcacacgggucggaaugggcgaggccgccgcuaucuucaugaccgcgacacccccugggucuguggaagccuuuccgcagagcaaugcugugauucaggaugaggaacgcgacauccccgagagauccuggaacucuggauaugaguggauuacagauuucccuggcaagaccgucugguuuguucccagcaucaaauccgggaaugacauugccaacugucuucggaagaauggaaagcgcgugauccagcugucuagaaaaacauucgauaccgaauaccaaaagacgaaaaacaacgacugggacuacguggucacaaccgauauuagcgagaugggcgccaauuuucgggcugacagagugaucgauccucgccggugccugaagcccguuauccucaaagacgggccggaaagagugauucuggccggcccuaugcccgucacaguggcguccgcugcccagcgccggggaagaaucggccgcaaccacaauaaggagggggaucaguauauuuacaugggacagccccuuaacaaugacgaggaucaugcccacuggaccgaagcuaagaugcugcucgacaacaucaauacgccugagggcauuauccccgcccuguucgaaccugagcgggagaaaagcgcggccaucgauggggaguauagacugcgcggagaggcuagaaagaccuucguugaacucaugcggcgcggcgaccuuccgguguggcugucuuacaaagucgccuccgagggguuucaauauagcgauagacgguggugcuucgacggcgaacgcaacaaucaggugcuggaggaaaacauggaugucgagauuuggacaaaggagggagaacgcaaaaagcuccggcccagauggcuggacgcucgcaccuacuccgacccucuugcccugcgggaguuuaaagaguucgcugccggcagacgcucugugagcggggaucucauccuggagauuggaaagcugccccagcaccucacacagcgggcgcaaaaugcccuugacaaccugguuaugcugcauaauuccgaacagggcgggagagcuuaucggcacgccauggaggagcucccugauaccaucgaaacacugaugcuucuggcucucauugccgugcugaccggaggcgugacgcuguuuuuccucucuggccgcgggcuuggaaagacaagcaucggccugcugugugucauggccuccagcguucuccuguggauggcuucuguggagccccauuggaucgcggccuccauuauccuugaauuuuuccugauggugcuccugauuccggagccugacagacagcggacaccccaggauaaccaacuggcuuacgucgugaucgggcuccuuuuuaugauucugaccguugccgccaaugagaugggacugcucgaaacaaccaaaaaggaccugggcaucgggcacgaggcugugggaaaccaccaucacgccgcgaugcuugaugucgaccugcauccugccagcgcuuggacacucuacgccguggcuacgaccauuaucacacccaugaugcgccacaccaucgaaaacacaaccgccaauauuucucugacggcgaucgccaaccaggcugccauucugaugggccucgauaaaggcuggccuaucuccaagauggacauuggggucccccuucuggcucugggaugcuauagccaggugaauccgcucacccugacagccgcuguucuuaugcugguggcccauuacgcgaucaucggcccugggcuccaagccaaagcuaccagagaggcccagaagcggacagcugccggaauuaugaagaaccccaccgucgauggcaucguggccauugaccuggaucccguuguguaugacgcgaaauucgaaaagcagcuggggcagaucaugcuccuuauucuguguacgucucaaauccugcucaugcgcacaaccugggcucugugcgagagcaucacacuugccaccggaccucugaccacacucugggagggcuccccgggcaaauuuuggaauacgaccauugcugucucuauggccaacaucuucagagggagcuaccuggccggagcuggccuggccuuuucccucaugaaaagccuugggggaggccggcgcgggacaggagcgcagggcgaaacccugggcgagaaauggaagagacagcugaaucagcucuccaagucugaguucaacacauauaaacggagcgggauuauggagguggacagauccgaagccaaggagggacugaaacgcggcgagaccacgaagcacgcugugucucgggggacagccaaacuuagaugguucguugaacgcaaucuggucaagcccgagggaaaggugaucgaucucggcugugggcggggaggcuggagcuacuauugcgcuggccugaaaaaggugaccgaagucaaaggguacaccaagggaggcccugggcacgaggaacccauuccuauggccacauacggauggaaccugguuaaacuccauuccggcaaggacguguuuuucauucccccugagaaaugugauacccuucugugcgacauuggggagucuagcccgaaucccacaaucgaagagggaagaacgcugcgcgugcucaagauggucgaaccuuggcugcggggcaaccaauuuuguaucaagauucuuaaucccuauaugccuuccgugguugagacccuggagcagaugcagagaaaacacggcgggaugcucgugcgcaacccccugagcagaaauucuacacaugaaauguacugggucuccugcggaaccggcaacaucgugagcgcgguuaauaugacaucuagaaugcugcucaaccgcuucaccauggcccaccggaagccgacguaugagagagauguggaccugggggcuggaacccgccacgucgccguggaaccugagguggcuaaccuugauauuaucggccagagaauugaaaauaucaaacaugagcacaaguccacauggcauuacgacgaggauaaccccuauaaaaccugggccuaccacgggagcuaugaagucaagcccucuggauccgcuagcuccaugguuaauggcguggugaagcugcucacaaaaccuugggacgucauccccauggugacccaaauugccaugacagauaccacgccuuuuggccagcagcggguuuucaaggagaaaguggacacacgcaccccgaaggcgaaaagagggaccgcccaaaucauggaagucacagcuaaguggcuguggggauuucuuagccggaacaagaaacccagaauuuguacgcgggaggaguucacccgcaaggugagaucuaaugccgcuaucggcgccguuuuuguggacgagaaccaguggaauagcgccaaagaggcggucgaagaugagcgguucugggaccuggugcaucgcgaaagagagcuccacaagcaggggaaaugcgcuacaugcguuuacaacaugaugggaaagcgggaaaagaaacugggcgaguuugggaaggccaaaggcucccgcgccauuugguacauguggcugggagcuagauuccucgaguuugaagcccugggcuucaugaaugaggaucacugguucucucgggaaaacagccuuuccgggguggagggagagggccugcauaagcucggguauauccugcgcgacaucucuaaaauuccuggaggcaauauguacgcugaugacaccgccgggugggauacaagaaucaccgaagacgaucuucagaacgaggcgcggauuacagacaucauggaacccgagcacgcccugcucgcuaagagcauuuuuaaacugaccuaucaaaauaaggucgugcgcguccagagaccugccaagaacggcacggugauggauguuaucucccggcgcgaccagagaggaucuggccagguggggaccuacggacugaauacauucaccaacauggaagcucaacucauccggcagauggagagcgagggcaucuuuucccccagcgaacuggagacaccgaaccuugccgaaagaguccuggauuggcucgagaaauaugggguggaacgccugaagcggauggcgaucucuggagacgacugugugguuaaaccuauugaugacagauucgccaccgcucuuacggcccugaaugauaugggcaaggugcgcaaagacaucccccagugggagccuuccaagggguggaacgauuggcagcaaguccccuuuugcagccaucacuuccaccagcucauuaugaaggacggccgggagaucgugguuccuuguagaaaucaggaugaacuggugggacgcgcucgggucucucagggcgccggguggucccugagagagacagcuugccucggaaaaagcuacgcccaaauguggcagcugauguauuuucaucgccgggaccuuagacuggcggccaacgcuauuuguuccgccgugcccgucgauuggaucccgaccucucgcacaaccuggagcauccacgcccaucaccaguggaugacgaccgaagacaugcucuccguguggaaucggguuuggauugaggaaaacccuuggauggaggauaagacacauaucagcucuuggggcgacgugcccuaccuggggaaaagagaggaccaauggugcggaucccuuauuggccugaccgcucgggccacaugggcgaccaauauccaggucgcuauuaaccaggugagacgccucaucgggaaugaaaacuaccuggauuauaugacaagcaugaagcgguucaaaaaugagucugaccccgaaggcgcccugugguga

SEQ ID NO: 18539 - RNA, 9879 nt, Artificial Sequence
  derived and/or modified CDS sequence (opt5) from DENV-1__GQ868637__SS-prME
agcgugaccaugcugcucaugcugaugcccacagcccuugcuuuccaccugacgacccggggcggggaaccucauaugaucgucuccaagcaggaacggggaaaaucucuccuguuuaagaccagcgccggcguuaauaugugcacccuuauugccauggaccugggggaacucugugaagauacaaugaccuacaaaugcccgagaaucacagaaguggaacccgacgauguggacuguuggugcaauaccacggauaccugggucacauauggaaccuguucccaaacaggcgagcaccggcgggacaagcgcucuguggcucuggccccucauguugggcugggacucgagaccagagccgaaacguggaugagcuccgagggcgcuuggaaacagauucagcggguggaaacaugggcccugcgccaccccggcuucaccgucaucgcucuuuuucuggcccaugcgauugggacaucuaucacccagaagggaaucauuuucauccuccugaugcuugugaccccuagcauggccaugagaugcguuggcauugggucccgggauuuuguggagggacugagcggcgcuacaugggucgacguggugcucgagcacgggucuugugucacgaccauggccaaggauaaacccacacuggacaucgaacugcucaagaccgagguuacaaacccugcugugcugcgcaaacuuugcauugaagccaagaucuccaauaccacgacagauagcagauguccgacccaaggagaggcgacccugguggaagaacaggacgccaacuucgucugccggcgcacauuuguggauagaggcuggggcaauggguguggacucuucggcaaagggucucugauuaccugcgcuaaguuuaagugcguuacaaaacuugagggaaagaucgugcaguacgaaaaccugaaauauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguagcccccggacaggccucgacuucaacgaaaugguccugcuuaccaugaaggagaaaagcuggcuggugcauaagcagugguuucucgaucugccucuucccuggacguccggggccucuacaagccaagagaccuggaaucgccaggaccugcucgucacauucaaaaccgcucacgcgaagaagcaggaagugguugugcugggaucccaagagggcgccaugcacaccgcucugacaggggccacggaaauucagaccagcggaacaaccacaaucuuugccggccaucucaaaugcagacugaagauggauaaacuuacccugaaggggaugucuuaugucauguguacgggcuccuucaaacucgagaaggaaguggcugagacacagcacggaaccguucuggugcagauuaaguacgagggcaccgacgccccgugcaaaaucccuuucagcacacaagaugaaaagggggucacccagaacggacggcugaucacagcgaaucccauugugacggacaaagagaagccugugaacaucgaagcugagccgcccuuuggcgagucuuauauuguuaucggggccggagaaaaagcccuuaagcucagcugguucaagaaaggcuccucuauugggaagauguuugaggcuaccgccagaggcgcucgccggauggccauccugggagauacagcgugggacuucggcagcaucgggggagucuuuaccuccgugggcaaacuggugcaucagauuuucgggacagccuacggaguccucuuuagcggcgugucuuggaccaugaagaucgggauuggcguucugcuuacguggcugggacucaauuccagaagcaccucucuguccaugacauguaucgcugugggccuggucacccuuuaccucggggugaugguucaggccgauagcggaugcgugauuaacuggaaaggccgcgaacugaaguguggguccggaaucuucgucacaaaugaggugcacaccuggacagaacaauauaaguuucaggcugacucuccuaaacggcugagcgccgcgauuggcaaggccugggaggaggggguuugcggcaucagauccgcuacccgccucgaaaacaucauguggcggcagauuucuaacgagcugaaucauauccuucuggaaaacgacaugaaauucacgguggucgugggagauguggucggcauucucgcccaggggaagaaaaugaucagaccgcaacccauggagcacaaguacagcuggaaauccuggggaaaggcuaagauuaucggcgccgacguucagaauacaaccuuuaucauugaugggccuaacacccccgaauguccugacgaucagcgcgccuggaauaucugggagguggaggacuauggauucggcauuuuuacaaccaacaucuggcugaaacugcgggauagcuacacgcaagugugcgaccacagacuuaugucugcugcgauuaaggauuccaaagccguccaugcugacaugggcuauuggaucgaaagcgagaagaaugaaacauggaaacucgcccgcgccucuuucaucgaggugaagaccuguauuuggcccaagucccacacacuguggagcaacgggguucuggaaucugagaugaucauuccgaaaaucuacggaggcccuauuagccaacauaauuaucggcccggguacuucacccagacagcuggaccuuggcaccucggcaagcuggagcuugauuuugaccugugcgaagggaccacgguggucguggaugagcacugcggaaacagaggccccucccuccggaccacaaccguuacaggcaaaaucauccaugaaugguguugccgcagcuguacccugccuccccugagauucaagggggaggacggaugcugguacggcauggagauucggccggugaaagaaagagaggaaaaucuugucaagucuaugguguccgccgggagcggagagguugacuccuuuucucucggccugcuguguaucagcauuaugaucgaagaggugaugcgcucccgguggucuagaaagaugcucaugacggggacacuggcggucuucuuucuucugauuaugggacagcucaccuggaacgaucugauccgccugugcauuauggugggcgcuaaugccagcgacagaaugggcauggggacaaccuaucuugcccugauggcuaccuucaaaaugcggccuauguuugccgugggacuccuguuccgcagacucacaucccgggagguccugcuucugacgaucggccucucucugguugcgagcguggaacugcccaacucccuugaggaacugggggauggacucgcuaugggcaucaugauucugaagcuccugaccgacuuucaaagccaccagcuuugggccacacugcucucucugaccuucaucaaaacaaccuuuucccugcauuacgccuggaagacgauggcuauggugcuuagcauugucucucugcucccccugugucucuccacaaccagccagaaaaccacauggcugccugugcuucuggggucucugggaugcaagccgcucaccauguuccugaucgccgagaauaagauuuggggccgcaaauccuggccccuuaacgaaggcaucauggcuguugggaucgugagcauucugcucuccagccugcucaagaacgaugucccucuggccggaccccuuaucgcgggcgggaugcugauugccuguuaugugaucucuggaagcuccgcugaccugucucucgagaaagccgcugagguuagcugggaagaggaagccgagcacuccggcgccucucauaauauucugguggaaguccaggaugacgggacaaugaagaucaaagaugaggagagagacgauacgcuuaccauccugcucaaggcuacacugcucgcggugagcggagucuacccucuguccauucccgccacccuuuuugugugguauuucuggcagaagaagaagcagcggucuggcguucugugggacacaccuuccccucccgaaguggagcgcgcuguccuggaugacggcaucuacagaauuaugcagcgggggcuccugggacgcucccaggugggcguugggguguuccaagaaaacgucuuucacaccauguggcacgugacgagaggagccgugcuuauguaucagggcaaacggcuggagcccagcugggccucuguuaagaaagaccucaucuccuacgggggaggcuggagacugcagggcagcuggaauaccggggaggaaguccaggugauugcuguggagcccggaaagaacccuaaaaauguccaaacagcccccggcaccuucaagacaccggaaggggaggugggagcgaucgcucucgauuuuaagccuggcaccucugggucccccauuguuaaccgcgaaggaaaaaucgugggccuguacggcaauggggucgugacaacgagcggaaccuauguuuccgccaucgcccaggcuaaggccucucaggagggcccucuucccgagauugaagacgagguguuccggaaaagaaaccugacaaucauggaucugcaucccgggagcggaaagacccgccgguaccucccugcgauugucagagaagcuaucaaacgcaagcugcggacccuuauucuggccccgacaagagugguugccuccgagauggcugaagcccucaagggcaugcccauccgcuaucaaacgaccgcugugaaaagcgagcacacagggcgggagaucgucgaccugaugugccaugccaccuuuacaaugagacugcucucuccugugcgggugcccaauuacaacaugauuaucauggaugaagcgcacuucaccgacccuuccagcauugccgcucgcggcuauaucucuacgagagucggaaugggcgaggccgcugccauuuuuaugacagccacacccccugggagcguugaggcuuucccgcaguccaaugcggugauccaggaugaggaacgggacauccccgagcgcucuuggaacagcggauacgaguggauuaccgauuuuccuggcaagacagugugguucguccccuccaucaaaucugggaaugacauugccaacugucuuagaaagaauggaaaacgggugauccagcugagcagaaagaccuuugauacagaauaucaaaagaccaaaaacaacgacugggacuacguugugacgacagauauuuccgagaugggcgcuaauuuccgcgccgaccgggucaucgauccuagacgcugccugaagcccgugauucucaaagacgggccggaacggguuauccuggccggcccuaugcccgugaccgucgcuagcgccgcgcagagacgcggacggaucggcagaaaccauaauaaggagggggaucaguacauuuauaugggacagccccuuaacaaugacgaggaucacgcucacuggacagaagccaaaaugcugcucgacaacaucaauaccccugagggcauuauccccgcccuguucgaaccugagcgcgaaaagucugcugccauugauggggaguacagacugcggggagaggcgcgcaagacguuuguggaacucaugagacggggcgaccuuccggucuggcuguccuauaaaguggccagcgagggguuccaauacuccgaucgcagauggugcuuugacggcgaacggaacaaucagguucuggaggaaaacauggauguggagaucuggaccaaggagggagaacgcaaaaagcuccgcccccgguggcuggacgcuagaacauauucugacccucuugcccugcgcgaguucaaagaauuugcugccggccggagaagcguguccggggaucucauccuggagauuggaaagcugccccagcaucucacccagcgggcucaaaaugcccuugacaaccuggucaugcugcacaauucugaacagggcgggcgcgcguacagacaugccauggaggagcucccugauacaaucgaaacccugaugcuucuggcucucauugccguucugacaggaggcgugacccuguucuuucucagcggccgggggcuuggaaaaacguccaucggccugcugugugugauggcuagcucugcccuccuguggauggccuccgucgagccccacuggauugcugcgagcaucauccuugaguucuuucugauggugcuccugauuccggagccugaccgccagagaacaccccaggauaaccaacuggccuauguugugaucgggcuccuuuucaugauucugaccgucgcugccaaugagaugggacugcucgaaaccacaaagaaggaccugggcaucgggcacguggccgucgagaaccaucaccaugcuaccaugcuugauguggaccugcacccugccucugcguggacacucuacgccguugcuacgaccauuaucacacccaugaugcggcauaccauugaaaacacaaccgccaauaucucccugacggcuaucgccaaccaggcggccauucugaugggacucgauaaaggcuggccuaucagcaagauggacauuggcgugccccuucuggcucuggggugcuacucucaggucaauccgcucacccugaucgccgcugugcuuaugcugguugcccacuaugcuauuaucggaccuggccuccaagccaaagcgacacgcgaggcccagaagagaaccgcugccgggaucaugaaaaaccccacaguggauggaauugucgcuaucgaccuggaucccgugguguacgacgccaaguuugaaaagcagcugggccagauuaugcuccuuauccuguguaccagccaaauucugcucaugcggacgacaugggcccugugcgaguccaucacccuugcgacagggccucugaccacccucugggagggaucuccgggcaaauucuggaauacaacgaucgcuguuagcauggccaacauuuuucgcggcuccuaucuggcuggggccggacuggccuucagccucaugaagucccuuggcgggggaagacggggcaccggggcucagggagaaacacugggcgagaaauggaagagacagcugaaucagcucucuaaaagcgaguucaacaccuacaagcgcuccggcaucauggaggucgaccggucugaagccaaggaggggcugagacgcggagagacaaccaaacacgcggugagccggggcacggccaaacuuagaugguuuguggaacgcaaucuggucaaacccgaggggaagguuauugaucucggauguggcagagggggaugguccuauuacugcgcuggccugaaaaaggugacagaagugaagggcuauaccaaagggggaccuggccaugaggaacccaucccuauggccaccuacggguggaaccuggucaagcuccacucuggaaaagacguguucuuuauucccccugagaagugugauacacuucugugcgacaucggcgagagcuccccgaaucccaccauugaagaggggagaacacugcgcguucucaaaaugguggaaccuuggcugcggggaaaccaauucuguaucaagauccuuaaucccuacaugccuagcgucguggagacgcuggagcagaugcagagaaaacauggcggcaugcucguucgcaacccccugucuagaaauuccacccacgaaauguauugggugagcugcgggacaggaaacauugucucugcugugaauaugaccuccagaaugcugcucaaccgcuuuacaauggcccacagaaagccgaccuacgagcgggauguggaccugggcgcggggacgcgccaugucgccguugaaccugagguggcuaaccuugauaucauuggacagagaaucgaaaauauuaagcacgagcauaaaagcaccuggcacuaugacgaggauaaccccuacaagacaugggccuaucauggcucuuacgaagugaaacccuccgggagcgcuuccagcauggucaauggagugguuaagcugcucaccaaaccuugggacgugauccccauggucacacaaaucgccaugaccgauacaaccccuuucggccagcagcggguguuuaaggagaagguugacacgagaacaccgaaagcuaagcggggcaccgcccaaauuauggaagugaccgcgcgcuggcuguggggguuccuuucuagaaacaaaaagccccggaucuguacacgcgaggaauuuacgagaaaaguccggagcaaugccgcuauuggagccguguucguugacgagaaccaguggaacuccgcuaaggaggccguggaagaugagcgcuuuugggaccugguccacagagaacgggagcuccacaagcagggcaaaugcgcgaccugcguguauaacaugauggggaagcgcgagaaaaagcugggagaguucggcaaagcgaaggggucuagagcuaucugguacauguggcugggcgcccgguuucucgaguucgaagcccugggauucaugaaugaggaucauugguuuagccgcgaaaacucccuuucuggcgucgagggggagggacugcacaagcucggcuacauucugagagacaucagcaaaaucccugggggaaauauguaugcugaugacacagccggcugggauacccggauuacagaagacgaucuucagaacgaggcuaagaucaccgacauuauggaacccgagcaugcccugcucgcgacauccaucuucaaacugaccuaccaaaauaaggugguucgcgugcagagaccugccaaaaacgggacggucauggaugugauuucucggagagaccagcgcggcagcggacaggugggcaccuaugggcugaauacauuuaccaacauggaagcucaacucauccggcagauggaguccgagggaaucuucagccccucugaacuggagacaccgaaccuugccgaaagaguucuggauuggcucgagaaguacggcguggaacgccugaaacggauggcuauuuccggggacgacugugucgugaagccuaucgaugacagauuugccaccgcgcuuacggcccugaaugauaugggaaagguucgcaaagacauuccccagugggagccuagcaagggcuggaacgauuggcagcaagugcccuucugcucucaccacuuucaucagcucaucaugaaagacgggcgggagauugucgugccuuguagaaaucaggaugaacuggucggccgcgcucgggugucccagggagccggcuggagccugagagagacagcuugccucgggaaguccuaugcccaaauguggcagcugauguacuuccaccgccgggaccuuagacuggcugccaacgcgaucuguucugccguucccguggauugggucccgaccagccggacaaccugguccauucaugcucaccaucaguggaugacgaccgaagacaugcucagcguguggaauagaguuuggaucgaugagaacccuuggauggaagacaaaacacacaucucuuccuggggagacgugcccuaucugggcaagcgcgaggaucaauggugcgggagccuuauuggacugaccgcccgggccacaugggcuaccaauauccaggucgccauuaaccaggugagacgccucaucggcaaugagaacuaccuggacuacaugacaucuaugaagagauuuaaaaaugaaagcgaucccgagggggcgcugugguga

SEQ ID NO: 18540 - RNA, 9879 nt, Artificial Sequence
  derived and/or modified CDS sequence (opt5) from DENV-1__GQ868639__SS-prME
uccgugaccaugcugcucaugcugaugcccacggcccuugcuuuccaccugacgaccagaggcggggaaccucauaugaucgucuccaagcaggaacggggaaaaucucuccuguuuaagacaagcgccggcguuaacaugugcacccuuauugccauggaccugggggaguucugugaagauacaaugaccuacaaaugcccgcgcaucuccgaagcugaacccgacgauguggacuguuggugcaaugccacagauaccugggugacguauggaaccuguucucaaacaggcgagcacagacgggacaagcgcagcguugcccucgcuccucauguggggcugggacuggagaccagaacagaaaccuggauguccucugagggcgccuggaaacagauucagcggguugaaacgugggcucuccgccaccccggcuuuacagugaucgcccuguuccuugcgcaugccauugggaccagcaucacacagaagggaaucauuuuuauccugcucaugcuggucaccccuuccauggcuaugagaugcgugggcauugggagccgggauuucguugagggacuuucuggcgccaccuggguggacgucgugcuggagcacggguccugugugacaacgauggcuaaggauaaacccacccucgacaucgaacugcugaagacagaggucaccaacccugccguucuccgcaaacugugcauugaagcgaagaucagcaauacaaccacggauucuagauguccgacacaaggagaggccacccuuguggaagaacaagacgcuaacuuugugugccggcgcaccuucgucgauagaggcuggggcaauggguguggacuguuuggcaaagggucccucauuacaugcgccaaguucaagugcgugaccaaacuggagggaaagaucguucaguacgaaaaccuuaaauauagcgugaucgucacagugcacacgggcgaccagcaucaaguugggaaugagucuaccgaacacggaacaaccgcuacaauuacaccccaggccccuuccacggagauccagcugaccgacuacggcgcccucacacuggauuguagcccccggaccggccuggacuuuaacgaaauggugcuccugacaaugaaggagaaauccuggcuuguccauaagcagugguuccuggaucucccucugcccuggaccucuggggcuagcacgucccaagagacauggaaucgccaggaccuucuggugaccuuuaaaacagcgcacgccaagaagcaggaagucgugguucucggaagccaagagggcgcuaugcacaccgcccugaccggggccacagaaauucagacgucuggaaccacaaccaucuucgcuggccaucugaaaugcagacucaagauggauaaacugacacuuaaggggauguccuaugugauguguaccggcagcuucaaacuggagaaggaagucgccgagacgcagcacggaacagugcucguucagauuaaguacgagggcaccgacgcgccgugcaaaaucccuuuuucuacccaagaugaaaagggggugacacagaacggacggcugaucaccgcuaaucccauugucacagacaaagagaagccugugaacaucgaagccgagccgcccuucggcgagagcuauauugugaucggggccggagaaaaagcucugaaacuuuccugguuuaagaaaggcucuagcauugggaagauguucgaggccacggcuagaggcgcccgccggauggcgauccucggagauaccgccugggacuuuggcuccaucgggggaguuuucacaagcgucggcaaacuggugcaucagauuuuugggaccgcuuacggagugcuguucucuggcgucuccuggacaaugaagaucgggauuggcgugcuccugaccuggcuuggacugaauagcagaucuacgucccucagcaugaccuguaucgccguuggccuggugacacuguaccuuggggucauggugcaggcugauuccggaugcguuauuaacuggaaaggccgcgaacucaagugugggucuggaaucuuugugaccaaugagguccacacauggaccgaacaauauaaguuccaggccgacagcccuaaacggcuguccgcggccauuggcaaggcuugggaggagggggugugcggcaucagaucugccacacgccuggaaaacaucauguggaaacagauuagcaacgagcucaaucauauccugcuugaaaacgacaugaaguuuaccguuguggucggagauguggcuggcauucuggcccaggggaaaaagaugauccggccgcaacccauggaguacaaauauuccuggaaaagcuggggaaaggccaagauuaucggcgcugacgugcagaauacgacauucaucauugaugggccuaacacccccgaauguccugacgaucagagagcguggaauaucugggaggucgaggacuacggauuuggcauuuucaccacaaacaucuggcucaagcugcgcgauucuuauacccagguuugcgaccaccggcugauguccgccgcuauuaaagauagcaaggccgugcacgccgacaugggcuacuggaucgaaucugagaaaaaugaaacguggaaacuugcuagagccuccuucaucgaggugaagacauguauuuggcccaaaagccauacccucuggucuaacgggguccuggaaagcgagaugaucauuccgaagaucuauggaggcccuauuucccaacacaauuaccgccccggguacuuuacacagaccgcgggaccuuggcaucugggcaaacucgagcuggauuucgaccuuugcgaagggacaaccgugguuguggaugagcacugcggaaaccggggccccagccugagaacgaccacagucaccggcaagaucauccacgaaugguguugccggucuuguacacucccuccccugcgcuuuaaaggggaggacggaugcugguauggcauggagauuagaccggugaaggaaaaggaggaaaaucugguuaaauccauggugagcgcuggguccggagaggucgacucuuucagccuuggccuccuguguaucuccauuaugaucgaagaggugaugcggucuagauggagccgcaagaugcugaugaccgggacgcucgccgucuuuuuccugcuuauuaugggacagcugacauggaacgaucucauccggcugugcauuauggugggcgccaaugcuuccgacagaaugggcauggggaugaccuaccuggcccuuauggcgacauuuaaaaugcgcccuauguucgcugucggacugcucuuuagacggcugaccucucgcgaggugcuccugcuuaccaucggccugagccucguggccuccgucgaacugcccaacagccuggaggaacuuggggauggacuggccaugggcaucaugauucucaagcugcucgcugacuuccaaucucaucagcugugggccacacuucugucccucacguuuaucaaaaccacauucagccugcacuaugcuuggaagaccauggccaugguucugucuauugugucccuuuuuccccugugucucagcacaaccucucagaagacgacauggcugccugugcuccuggggucccuuggaugcaaaccgcugaccauguuccugaucgcggagaauaagauuuggggcagaaaaagcuggccccucaacgaaggcaucauggccgucgggaucguguccauucugcuuagcucucugcucaagaacgauguuccucuggcuggaccccucaucgccggcgggaugcugauugcuuguuacgugaucagcggauccucugccgaccuuagccuggagaaagccgcugaggucuccugggaagaggaagcggagcauucuggcgccagccacaauauucugguggaaguucaggaugacgggaccaugaagaucaaagaugaggagcgggacgauacacucaccauccugcuuaaggcuacacugcucgccguguccggagucuauccucugucuauucccgccacacucuucgugugguacuuuuggcaaaagaaaaagcagcgcagcggcguccugugggacaccccuagcccucccgaaguggagagagcuguucuugaugacggcaucuaucggauuaugcagcgcgggcugcugggaagaagccaggugggcgucgggguguuccaagaaaacguuuuucauacaauguggcacgugacccggggagccguccucauguaccagggcaaacgccuggagcccucuugggcguccgugaagaaagaccuuaucagcuacgggggaggcuggagacugcagggcucuuggaauacaggggaggaagugcagguuauugcugucgagcccggaaagaacccuaagaaugugcaaaccgcccccggcacguucaaaaccuccgaaggggaggugggagccaucgcucucgauuuuaagccgggcacaagcggguccccuauugucaaccgggaaggaaaaaucgugggccuguauggcaaugggguugugaccacaucuggaaccuacgucagcgccaucgcgcaggcuaaggccucccaggagggcccccucccugagauugaagacgagguguucagaaaacgcaaccugacaaucauggaucuucaccccgggagcggaaagacgcggagauaucugcccgccauuguucgcgaagcuaucaagcggaaacugagaacccucauucuggccccuacacgcguggucgcuucugagauggccgaagcgcuuaagggcaugccgauccgguaccaaaccaccgccgugaaauccgagcauacagggaaggagaucguugaccugaugugccacgcuacguuuaccaugagacuccugagccccgugcgcgucccuaauuauaacaugauuaucauggaugaagcccauuucacagaccccucuagcauugcugcccggggcuacaucuccaccagagugggaaugggcgaggccgcugcgauuuuuaugacagccaccccucccgggucugcugaagccuucccucagagcaaugccgugauccaggaugaggaacgggacaucccggagcgcuccuggaacucuggauaugaguggauuacggauuuucccggcaaaacagucugguucguuccuagcaucaaguccgggaaugacauugcuaacugucugagaaagaauggaaaacgggugauccagcucagccgcaagaccuucgauaccgaauaccagaagaccaagaacaacgacugggacuacguggucaccacagauauuucugagaugggcgccaauuuuagagcggaccgggugaucgaucccagacgcugccuuaaaccuguuauucugaaggacgggcccgaacgggugauccuggcuggcccgaugccugucaccguggccuccgccgcucagagacgcggacggaucggcagaaaccacaauaaggagggggaucaguauauuuacaugggacagccccucaacaaugacgaggaucaugcccacuggacggaagcgaaaaugcugcuugacaacaucaauacacccgagggcauuaucccugcccuguucgaacccgagcgcgaaaagagcgcugccauugauggggaguaucggcucagaggagaggcucgcaaaaccuuuguugaacugaugagacggggcgaccugccuguguggcucuccuacaaggucgccucugagggguuccaauauagcgaucgcagauggugcuuugacggcgaacggaacaaucaggugcuugaggaaaacauggaugucgagaucuggacaaaagagggagaacgcaagaaacugagaccgcgguggcuggacgcuagaaccuacuccgacccccucgcccugcgcgaguucaaggaauuugcggccggccggagaucugugagcggggaucuuauccuggagauuggaaagcucccucagcaccugacgcagcgcgcucaaaaugcccuggacaaccucguuaugcuucauaauuccgaacagggcgggcgggcuuauagacacgccauggaggagcugcccgauaccaucgaaacacugaugcuccuggcccuuauugcugugcugaccggaggcgugacacucuucuuucugagcggccgggggcugggaaaaaccucuaucggccuccuuugugucauggcguccagcguucugcuguggauggccucuguggagccucauuggauugcugccuccaucauccucgaguucuuucugauggugcuucugauucccgagccggaccgccagagaacaccucaggauaaccaacucgccuacgucgugaucgggcugcuguucaugauucucaccguugcugccaaugagaugggacuucuggaaacgacaaagaaagaccugggcaucgggcacguggcggucgagaaccaccaucacgccgcuaugcucgauguggaccugcaucccgccagcgcuuggacccuuuacgccgucgcgaccacaauuaucaccccuaugaugcggcacacaauugaaaacacgaccgccaauaucucucugacagcuaucgccaaccaggcugccauucucaugggacuggauaagggcuggcccaucagcaaaauggacauuggcgugccucugcucgcucuugggugcuauucccagguuaauccccugacccugacagccgcggugcucaugcuggucgcccauuacgcuaucauuggaccgggccuucaagccaaggcuacccgcgaggcccagaagagaacggccgcggggaucaugaaaaacccuaccguggauggaaucguugcuauugaccuggaucccguggucuaugacgccaaguuugaaaaacagcucggccagaucaugcugcugauucucuguacaucucaaauccuucugaugcggaccacaugggcucugugcgagagcauuacccucgccacggggccccugacaacccuuugggagggauccccuggcaaguucuggaauacaaccaucgccgugagcauggcuaacaucuuccgcggcuccuaccuggccggggcgggacucgccuuuucucugaugaaaagccugggcgggggaagacggggcaccggggcucagggagaaacacucggcgagaaguggaagcgccagcuuaaucagcuguccaaaucugaguucaacacguauaagagaagcggcauuauggagguggaccgguccgaagccaaagaggggcugaagagaggagagaccacaaaacacgcuguuucucgcggcaccgccaagcuccggugguuugucgaaagaaaucuggugaagccggaggggaaagugaucgaucuuggauguggccgcgggggauggagcuacuauugcgcgggccugaagaaagucacagaaguuaagggcuacaccaaagggggacccggccacgaggaaccuauucccauggccacguacggguggaaccucgugaagcugcauuccggaaaagacguguucuuugucccucccgagaagugugauacacugcucugcgacaucggcgagagcucuccuaauccgaccauugaagaggggcggacccuuagagugcugaagaugguugaacccuggcugcgcggaaaccaauucuguaucaaaauucucaauccuuauaugcccuccguggucgagacacuggagcagaugcagcggaagcacggcggcaugcuugugagaaacccucugagccgcaauucuacccaugaaauguacuggguuuccugcgggacaggaaacaucgugagcgcugucaauaugacgucucggaugcuccugaacagauuuaccauggcccaccgcaaacccacauaugagcgggauguggaccugggcgcugggaccagacacguggccgucgaaccggagguugcuaaccucgauaucauuggacagcgcaucgaaaauauuaagcaugagcacaaauccacauggcauuacgacgaggauaacccuuauaagaccugggccuaccacggcagcuaugaagugaagcccuccgggagcgcgucuagcauggugaauggagucgugaaacugcuuacgaagcccugggacguuaucccuauggugacccaaauugccaugacagauaccacacccuucggccagcagagagucuuuaaagagaagguggacacccggacaccuaaagcuaagcgcggcaccgcccaaaucauggaaguuacggcuaaguggcuguggggguuccucuccagaaacaaaaagccgcggaucuguacaagagaggaauuuacccggaaagugcgcucuaaugccgccauuggagcggucuucguggacgagaaccaguggaauagcgcuaaggaggccguugaagaugagagauuuugggaccuggugcaucgggaacgcgagcuucacaaacagggcaagugcgcgaccugcgucuacaacaugauggggaagagagagaagaagcugggagaguucggcaaagcuaaggggucccgggccaucugguacauguggcucggcgcucgcuuccuggaguuugaagcccugggauucaugaaugaggaucacugguuuucuagagaaaacagccucuccggcguggagggggagggacugcauaaacuuggcuauauucugcgggacaucucuaagauuagcgggggaaauauguacgcggaugacacagccggcugggauacgcgcaucaccgaagacgaucuccagaacgaggcuaaaaucacagacauuauggaacccgagcacgcccugcuugcuaaguccaucuucaagcugaccuaucaaaauaaagucgugagaguucagcggccugccaagaacgggacagugauggaugucauuagccgcagagaccagcggggcucuggacaggugggcaccuacgggcucaauacauuuaccaacauggaagcgcaacugauccgccagauggaguccgagggaauuuucagccccucugaacuggagacgccuaaccucgccgaaagagcucuggauuggcuugagaaacauggcguggaacggcugaagagaauggccaucuccggggacgacuguguugugaaacccaucgaugaccgcuuugcuaccgcccucacagcucugaaugauaugggaaagguccggaaggacauuccgcagugggagccuagcaaaggcuggaacgauuggcagcaagugcccuucugcucccaccacuuucaucagcuuaucaugaaggacgggagagagauuguugugccuugucgcaaucaggaugaacuggucggccgggccagagugucucagggagcgggcuggagccuccgcgagaccgccugccuggggaaauccuaugcucaaauguggcagcugauguacuuccaccggagagaccuccgccuggccgccaacgcuaucuguagcgccguccccguggauuggguuccuacaucucggaccacgugguccauucaugcgcaccaucaguggaugacaaccgaagacaugcuuagcguguggaauagagucuggaucgaggaaaaccccuggauggaggauaagacacacauuucuagcugggaggacgugccguaucugggaaaacgcgaagaccaauggugcggcucccucaucgggcugaccgcucgggccacgugggccaccaauauccagguugcuauuaaccaggugagacggcuuaucggaaaugagaacuaccuggauuacaugacaucuaugaagagauuuaagaaugaaagcgacccugagggcgcccucugguga

SEQ ID NO: 18541 - RNA, 9879 nt, Artificial Sequence
  derived and/or modified CDS sequence (opt5) from DENV-1__GU131925__SS-prME
agcgugaccaugcugcucaugcugaugcccaccgcccuugcuuuccaccugacgaccagaggcggggagccucauaugaucguguccaagcaggaacggggaaaaucucuccuguuuaagaccagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaaguucacagugguugugggagaugucgcuggcauccucgcccaggggaaaaagaugauucggccgcaacccauggaguacaaauauucuuggaaaagcuggggaaaggccaagaucaucggcgcugacgugcagaauaccaccuuuauuaucgaugggccuaacacacccgaauguccugacgaucagagagcguggaauauuugggagguggaggacuacggauucggcaucuuuaccacgaacauuuggcugaagcugcgcgauuccuauacacaggucugcgaccaccggcuuaugagcgccgcuaucaaagauucuaaggccguucacgccgacaugggcuacuggaucgaauccgagaaaaaugaaaccuggaagcucgcuagagccagcuucauugaggugaagacauguaucuggcccaaaucucauacccugugguccaacggggugcuggaaagcgagaugauuaucccgaagauuuauggaggcccuaucucucaacacaauuaccgccccggguacuucacacagaccgcgggaccuuggcaucucggcaaacuggagcuugauuuugaccugugcgaagggacgaccgucgugguugaugagcacugcggaaaccggggccccagccucagaacaaccacagugaccggcaagaucauucacgaaugguguugccgguccuguacgcugccuccccugcgcuucagaggggaggacggaugcugguauggcauggagauccggccggucaaagaaaaggaggaaaaucuugucaagagcaugguuucugcuggguccggagagguggacagcuuuucccucggccugcuguguauuucuaucaugauugaagaggucaugagaagccgcuggucccggaaaaugcucaugacagggacccuggccguguuccuucugcucaucaugggacagcugacauggaacgaucugauuagacuuugcaucaugguuggcgccaaugcuucugaccgcaugggcauggggaccaccuaccuggcccucauggcgacauuuaagaugagaccuauguucgcugugggacugcucuuucggcgccugacgagcagagagguccuucugcucaccaucggccugucccugguggccucuguggaacuucccaacagccuggaggaacucggggauggacuggccaugggcauuaugauccucaaacugcuuacagacuuccaaucccaucagcugugggcuacccuccugagccugacauuuauuaagaccacguucucucuucacuaugccuggaaaacaauggcuaugguccuguccaucguuagccucuuuccccugugucucucuaccaccucccagaagacaaccuggcugccugugcuucuggggagccugggaugcaagccgcucacaauguuccugauugccgagaauaaaaucuggggccggcgcucuuggccccuuaacgaaggcaucauggcgguggggauugucuccauccugcucagcucccugcucaagaacgaugugccucuggccggaccccuuauugcuggcgggaugcugaucgccuguuacguuauuagcggaucuagcgcugaccugucccucgagaaagccgccgaggugucuugggaagaggaagcugagcauagcggcgcgucccacaauauccuggucgaagugcaggaugacgggacgaugaagaucaaagaugaggagagagacgauacccuuacaauucugcucaaggccacccugcucgcuguuucuggaguguauccucugagcauccccgccacacuuuuugucugguacuucuggcagaagaagaagcagcgguccggcgugcugugggacaccccuucucccccggaagucgagcgcgccgugcuggaugacggcauuuauagaaucaugcagcgggggcuccugggacgcagccagguuggcgugggggucuuccaagaaaacguguuucauacgauguggcacguuaccagaggagcugugcuuauguaccagggcaaacggcuggagccuuccugggccagcgucaagaaagaccucauuucuuacgggggaggcuggagacugcagggcuccuggaauacaggggaggaagugcaagugaucgcgguugagcccggaaagaacccuaaaaauguccaaaccgcucccggcacauucaagaccccggaaggggaggugggagccauugcccucgauuuuaagccuggcacaagcgggucucccaucgugaaccgcgaaggaaaaaucgucggccuguauggcaauggggugguuacgaccuccggaacauacgugagcgcuauugcccaggcgaaggcuucccaggagggcccucuucccgagaucgaagacgaggucuuccggaaaagaaaccugaccauuauggaucugcaccccgggucuggaaagacccgccgguaucucccugccaucgugagagaagccauuaaacgcaagcugcggacacuuauccuggcuccgacgagaguuguggccagcgagauggcugaagcccucaagggcaugcccauccgcuaccaaaccacagcggucaaauccgagcauaccgggaaggagauuguggaccugaugugccacgccacauuuaccaugcggcugcucagcccuguuagagugcccaauuauaacaugaucauuauggaugaagcucauuucacggacccuucuuccaucgccgcucggggcuacauuagcacacgcgucggaaugggcgaggccgccgcuaucuuuaugaccgcgacacccccugggucuguggaagccuucccgcagagcaaugcugugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacauuugauaccgaauaccagaaaacgaagaacaacgacugggacuacguggucacaaccgauaucagcgagaugggcgccaauuucagagcugaccgcgugauugauccucggagaugccugaaacccguuauccucaaggacgggccggaacgcgugauccuggccggcccuaugcccgucacaguggcguccgcugcccagcggagaggacgcauuggccggaaccacaauaaagagggggaucaguauaucuacaugggacagccccuuaacaaugacgaggaucaugcccacuggaccgaagcuaagaugcugcucgacaacauuaauacgccugagggcaucauucccgcccuguucgaaccugagagagaaaagagcgcggccaucgauggggaguaucgccugagaggagaggcucggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcgcaaaaugcccuugacaaccugguuaugcugcauaauuccgaacagggcgggcgggcuuaucgccacgccauggaggagcucccugauaccauugaaacacugaugcuucuggcucucaucgccgugcugaccggaggcgugacgcuguucuuucucucuggcagagggcuuggaaagacaagcauuggccugcugugugucauggccuccagcguucuccuguggauggcuucuguggagccccauuggaucgcggccuccaucauucuugaguucuuucugauggugcuccugaucccggagccugaccggcagcgcacaccccaggauaaccaacuggcuuacgucgugauugggcuccuuuucaugauccugaccguugccgccaaugagaugggacugcucgaaacaaccaagaaagaccugggcauugggcacguggcugucggaaaccaccaucacgccgcgaugcuugauguggaccugcauccugccagcgcuuggacacucuacgccgucgcuacgaccaucauuacacccaugaugagacacaccaucgagaacacaaccgccaauaucucucugacggcgauugccaaccaggcugccauccugaugggccucgauaagggcuggccuauuuccaaaauggacaucggggugccccuucuggcucugggaugcuauagccagguuaauccgcucacccugacagccgcugugcuuaugcuggucgcccauuacgcgauuaucggcccugggcuccaagccaaggcuacccgggaagcccagaaacgcacagcugccggaaucaugaagaaccccaccguggauggcauuguugccaucgaccuggaucccguggucuaugacgcgaaguuugagaaacagcuggggcagauuaugcuccuuauccuguguacgucucaaauucugcucaugagaacaaccugggcucugugcgaaagcaucacacuugccaccggaccucugaccacacucugggagggcuccccgggcaaguucuggaauacgaccaucgcugugucuauggccaacauuuuucgggggagcuaccuggccggagcuggccuggccuucucccucaugaaaagccuugggggaggccgcagagggacaggagcgcagggcgagacccugggcgaaaaguggaaacggcagcugaaucagcucuccaagucugaguucaacacauauaagagaagcgggaucauggaaguggaccgcuccgaggccaaagaaggacugaagcggggcgagaccacgaaacacgcuguuucuagagggacagccaaacuucgcugguuugucgagcggaaucuggugaaacccgaaggaaaggugauugaucucggcugugggagaggaggcuggagcuacuauugcgcuggccugaagaaagucaccgagguuaagggguacaccaaaggaggcccugggcacgaagaacccaucccuauggccacauacggauggaaccuggugaagcuccauuccggcaaagacguguucuuuauucccccugaaaagugugauacccuucugugcgacaucggggagucuagcccgaaucccacaauugaggaaggacgcacgcugcggguccucaaaaugguggagccuuggcugagaggcaaccaauucuguaucaagauccuuaaucccuauaugccuuccguuguggaaacccuggagcagaugcagcgcaagcacggcgggaugcucguccggaacccccugagcagaaauucuacacaugagauguacuggguguccugcggaaccggcaacauuguuagcgcggugaauaugacaucucgcaugcugcucaaccgguuuaccauggcccacagaaaaccgacguaugaacgcgaugucgaccugggggcuggaaccagacacguggccguggagccugaagucgcuaaccuugauaucauuggccagcggaucgagaauauuaagcaugaacacaaauccacauggcauuacgacgaggauaaccccuauaagaccugggccuaccacgggagcuaugagguuaaacccucuggauccgcuagcuccauggugaauggcguggucaagcugcucacaaagccuugggacgugauccccaugguuacccaaaucgccaugacagauaccacgccuuucggccagcagcgcguguuuaaagaaaaggucgacacaagaaccccgaaagcgaagcgggggaccgcccaaauuauggaggugacagcuaaauggcuguggggauuccuuagcagaaacaagaagccccggaucuguacgcgcgaagaguuuaccagaaaaguucggucuaaugccgcuauuggcgccguguucgucgacgaaaaccaguggaauagcgccaaggaggcgguggaggaugaacgcuuuugggaccugguucauagagagcgggaacuccacaaacaggggaagugcgcuacaugcguguacaacaugaugggaaaacgcgagaagaagcugggcgaguucgggaaagccaagggcuccagagccaucugguacauguggcugggagcucgguuucucgaguucgaggcccugggcuucaugaaugaagaucacugguuuucucgcgagaacagccuuuccggggucgaaggagagggccugcauaaacucggguauauucugagagacaucucuaagaucccuggaggcaauauguacgcugaugacaccgccgggugggauacacggauuaccgaggacgaucuucagaacgaagcgcgcaucacagacauuauggagcccgaacacgcccugcucgcuaaaagcaucuucaagcugaccuaucaaaauaaaguggucagagugcagcggccugccaagaacggcacgguuauggaugugauuucccgcagagaccagcggggaucuggccaggucgggaccuacggacugaauacauuuaccaacauggaggcucaacucaucagacagauggaaagcgagggcaucuucucccccagcgagcuggaaacaccgaaccuugccgagcgcgugcuggauuggcucgaaaaguaugggguggagcggcugaaaagaauggcgauuucuggagacgacuguguugugaagccuaucgaugaccgcuuugccaccgcucuuacggcccugaaugauaugggcaaaguccggaaggacauuccccagugggaaccuuccaaaggguggaacgauuggcagcaagugcccuucugcagccaucacuuucaccagcucaucaugaaggacggcagagagauuguugugccuugucgcaaucaggaugagcuggucggacgggcuagagugucucagggcgccggguggucccugcgcgaaacagcuugccucggaaagagcuacgcccaaauguggcagcugauguauuuccaucggagagaccuucgccuggcggccaacgcuaucuguuccgccguccccguggauuggauuccgaccucucggacaaccuggagcauccacgcccaucaccaguggaugacgaccgaggacaugcucuccguuuggaauagaguguggaucgaagagaacccuuggauggaagauaaaacacauauuagcucuuggggcgacguccccuaccuggggaagcgggaggaccaauggugcggaucccuuaucggccugaccgcuagagccacaugggcgaccaauauucagguggcuaucaaccagguucgccggcucauugggaaugagaacuaccuggauuauaugacaagcaugaaaagauuuaagaaugaaucugaccccgagggcgcccugugguga

SEQ ID NO: 18542 - RNA, 9879 nt, Artificial Sequence
  derived and/or modified CDS sequence (opt5) from DENV-1__GU131926__SS-prME
uccgugaccaugcugcucaugcugaugcccaccgcccuugcuuuccaccugacgaccagaggcggggaaccucauaugaucgucuccaagcaggaacggggaaagucucuccuguuuaagacaagcgccggcguuaacaugugcacccuuauugcgauggaccugggggaguucugugaagauacaaugaccuacaaaugcccgcgcaucuccgaagcugaacccgacgauguggacuguuggugcaaugccacagauaccugggugacguauggaaccuguucucaaacaggcgagcacagacgggacaagcgcagcgucgcccucgcuccucauguggggcugggacuggagaccagaacagaaaccuggauguccucugagggcgccuggaaacagauucagcggguugaaacgugggcucuccgccaccccggcuuuacagugaucgcccuguuccuugcgcaugccauugggaccagcaucacacagaagggaaucauuuuuauccugcucaugcuggucaccccuuccauggcuaugagaugcgugggcauugggagccgggauuucguugagggacuuucuggcgccaccuggguggacgucgugcuggagcacggguccugugugacaacgauggcuaaggauaaacccacccucgacaucgaacugcugaagacagaggucaccaacccugccguucuccgcaaacugugcauugaagcgaagaucagcaauacaaccacggauucuagauguccgacacaaggagaggccacccuuguggaagaacaagacgcuaacuuugugugccggcgcaccuucgucgauagaggcuggggcaauggguguggacuguuuggcaaagggucccucauuacaugcgccaaguucaagugcgugaccaaacuggagggaaagaucguucaguacgaaaaccuuaaauauagcgugaucgucacagugcacacgggcgaccagcaucaaguugggaaugagucuaccgaacacggaacaaccgcuacaauuacaccccaggccccuuccacggagauccagcugaccgacuacggcgcccucacacuggauuguagcccccggaccggccuggacuuuaacgaaauggugcuccugacaaugaaggagaaauccuggcuuguccauaagcagugguuccuggaucucccucugcccuggaccucuggggcuagcacgucccaagagacauggaaucgccaggaccuucuggugaccuuuaaaacagcgcacgccaagaagcaggaagucgugguucucggaagccaagagggcgcuaugcacaccgcccugaccggggccacagaaauucagacgucuggaaccacaaccaucuucgcuggccaucugaaaugcagacucaagauggauaaacugacacuuaaggggauguccuaugugauguguaccggcagcuucaaacuggagaaggaagucgccgagacgcagcacggaacagugcucguucagauuaaguacgagggcaccgacgcgccgugcaaaaucccuuuuucuacccaagaugaaaagggggugacacagaacggacggcugaucaccgcuaaucccauugucacagacaaagagaagccugugaacaucgaagccgagccgcccuucggcgagagcuauauugugaucggggccggagaaaaagcucugaaacuuuccugguuuaagaaaggcucuagcauugggaagauguucgaggccacggcuagaggcgcccgccggauggcgauccucggagauaccgccugggacuuuggcuccaucgggggaguuuucacaagcgucggcaaacuggugcaucagauuuuugggaccgcuuacggagugcuguucucuggcgucuccuggacaaugaagaucgggauuggcgugcuccugaccuggcuuggaguuaauagcagaucuacgucccugagcaugaccuguaucgccgugggccucgucacacuguaccugggggugaugguucaggcugauuccggaugcgugauuaacuggaaaggccgcgaacuuaagugugggucuggaaucuuugucaccaaugaggugcacacauggaccgaacaauauaaguuccaggccgacagcccuaaacggcucuccgcggccauuggcaaggcuugggaggaggggguuugcggcaucagaucugccacacgccuggaaaacaucauguggaaacagauuagcaacgagcugaaucauauccuccuggaaaacgacaugaaguuuaccguggucgugggagauguggcuggcauucuugcccaggggaaaaagaugauccggccgcaacccauggaguacaaauauuccuggaaaagcuggggaaaggccaagauuaucggcgcugacguccagaauacgacauucaucauugaugggccuaacacccccgaauguccugacgaucagagagcguggaauaucugggagguugaggacuacggauuuggcauuuucaccacaaacaucuggcugaagcuccgcgauucuuauacccaggugugcgaccaccggcugauguccgccgcuauuaaagauagcaaggccgugcacgccgacaugggcuacuggaucgaaucugagaaaaaugaaacguggaagcuggcuagagccuccuucaucgaggucaagacauguauuuggcccaaaagccauacccuuuggucuaacggggugcucgaaagcgagaugaucauuccgaagaucuauggaggcccuauuucccaacacaauuaccgccccggguacuuuacacagaccgcgggaccuuggcaucugggcaaacuggagcucgauuucgaccugugcgaagggacaaccguuguggucgaugagcacugcggaaaccggggccccagccuuagaacgaccacagugaccggcaagaucauccacgaaugguguugccggucuuguacacugccuccccuccgcuuuaaaggggaggacggaugcugguauggcauggagauuagaccgguuaaggaaaaggaggaaaaucuggugaaauccauggucagcgcuggguccggagagguggacucuuucagccugggccuucucuguaucuccauuaugaucgaagagguuaugcggucuagauggagccgcaagaugcugaugaccgggacgcuggccguguuuuuccuccugauuaugggacagcuuacauggaacgaucugauccggcucugcauuauggucggcgccaaugcuuccgacagaaugggcauggggaugaccuaccuggcccugauggcgacauuuaaaaugcgcccuauguucgcugugggacuucuguuuagacggcucaccucucgcgaggugcugcuccugaccaucggccuuagccuggucgccuccguugaacuccccaacagccuggaggaacugggggauggacuugccaugggcaucaugauucugaagcuccugacagacuuccaaucucaucagcucugggcuacgcugcuuucccugaccuuuaucaaaacaaccuucagccuccacuaugccuggaagacaauggcuauggugcugucuauugugucccuguuuccccuuugucugagcaccacgucucagaagacaaccuggcucccuguccugcucgggucccugggaugcaaaccgcuuaccauguuccugaucgccgagaauaagauuuggggcagaaaaagcuggccccugaacgaaggcaucauggcgguggggaucguuuccauucuccugagcucucuucugaagaacgaugugccucucgccggaccccugaucgcuggcgggaugcucauugccuguuacgucaucagcggauccucugcugaccugagccuugagaaagccgccgagguguccugggaagaggaagcugagcauucuggcgcgagccacaauauucugguugaagugcaggaugacgggacaaugaagaucaaagaugaggagcgggacgauacccugacaauccuccugaaggccacgcuucuggcugucuccggaguguauccucucucuauucccgccacccuguucgucugguacuuuuggcaaaagaaaaagcagcgcagcggcgugcucugggacacaccuagcccucccgaaguugagagagccgugcuggaugacggcaucuaucggauuaugcagcgcgggcuucugggaagaagccaggucggcguggggguuuuccaagaaaacguguuucauaccauguggcacgucacacggggagcugugcugauguaccagggcaaacgccucgagcccucuugggccuccgugaagaaagaccugaucagcuacgggggaggcuggagacuucagggcucuuggaauaccggggaggaaguucaggucauugcgguggagcccggaaagaacccuaagaaugugcaaacggcucccggcaccuucaaaacauccgaaggggaggucggagccaucgcccuggauuuuaagccgggcaccagcggguccccuauugugaaccgggaaggaaaaaucguuggccucuauggcaaugggguggucacaaccucuggaacauacgugagcgcuaucgcccaggcgaaggcuucccaggagggcccccugccugagauugaagacgagguuuucagaaaacgcaaccucacgaucauggaucugcaccccgggagcggaaagacccggagauaucuucccgccauugugcgcgaagccaucaagcggaaacugagaacacugauucucgcuccuacccgcgucguggccucugagauggcugaagcccugaagggcaugccgauccgguaccaaaccacagcgguuaaauccgagcauacggggaaggagaucguggaccuuaugugccacgccaccuuuacaaugagacugcucagccccguccgcgugccuaauuauaacaugauuaucauggaugaagcucauuucaccgaccccucuagcauugccgcucggggcuacaucuccacaagagugggaaugggcgaggccgccgcuauuuuuaugaccgcgacgccucccgggucugccgaggcuuucccucagagcaaugccgucauccaggaugaagaacgggacaucccggagcgcuccuggaacucuggauaugaguggauuacagauuuucccggcaaaaccguuugguucgugccuagcaucaaguccgggaaugacauugccaacugucugagaaagaauggaaaacgggugauccagcugagccgcaagaccuucgauacagaauaccagaagaccaagaacaacgacugggacuacgucgugacaaccgauauuucugagaugggcgcuaauuuuagagccgaccggguuaucgaucccagacgcugccucaaaccugugauucuuaaggacgggcccgaacgggucauccuggcgggcccgaugccugugacgguugcuuccgccgcccagagacgcggacggaucggcagaaaccacaauaaggagggggaucaguauauuuacaugggacagccccugaacaaugacgaggaucaugcucacuggacagaagccaaaaugcuccuggacaacaucaauacccccgagggcauuaucccugcgcuuuucgaacccgagcgcgaaaagagcgccgcuauugauggggaguaucggcugagaggagaggcccgcaaaacauuuguggaacucaugagacggggcgaccugccugucuggcuguccuacaagguggcuucugagggguuccaauauagcgaucgcagauggugcuuugacggcgaacggaacaaucagguccucgaggaaaacauggauguggagaucuggaccaaagagggagaacgcaagaaacuuagaccgcgguggcuggacgccagaacguacuccgacccccuggcucuccgcgaguucaaggaauuugccgcgggccggagaucuguuagcggggaucugauccuugagauuggaaagcugccucagcaccucacccagcgcgcccaaaaugcucuggacaaccuggugaugcuccauaauuccgaacagggcgggcgggccuauagacacgcuauggaggagcuucccgauacaaucgaaacccugaugcugcucgcccugauugccgugcuuacaggaggcgucacccuguucuuucucagcggccgggggcugggaaaaacaucuaucggccugcucuguguuauggcuuccagcgugcuucuguggauggcgucuguggagccucauuggauugccgcuuccaucauccuggaguucuuucucaugguccugcuuauucccgagccggaccgccagagaaccccucaggauaaccaacuggccuacgugguuaucgggcuccuguucaugauucugacgguggccgcuaaugagaugggacuccuugaaacaaccaagaaagaccugggcaucgggcacgucgccguggagaaccaccaucacgcggccaugcuggaugucgaccuccaucccgcuagcgccuggacccuguacgcuguggccacaaccauuaucacaccuaugaugcggcacacgauugaaaacaccacagcgaauaucucucuuaccgccaucgcuaaccaggccgcuauucugaugggacucgauaagggcuggcccaucagcaaaauggacauuggcguuccucugcuggcccucgggugcuauucccaggugaauccccuuacacugaccgcugccguccugaugcucguggcgcauuacgccaucauuggaccgggccugcaagcuaaggccacgcgcgaggcucagaagagaaccgccgccgggaucaugaaaaacccuacaguugauggaaucguggcgauugaccuugaucccgucguguaugacgcuaaguuugaaaaacagcugggccagaucaugcuccugauucuguguaccucucaaauccuccuuaugcggacaaccugggcccugugcgagagcauuacgcuggcuacagggccccucaccacacugugggagggauccccuggcaaguucuggaauaccaccaucgccgugagcauggccaacaucuuccgcggcuccuaccuugcuggggccggacuggcguuuucucucaugaaaagccugggcgggggaagacggggcacaggggcccagggagaaacgcugggcgagaaguggaagcgccagcucaaucagcuuuccaaaucugaguucaacaccuauaagagaagcggcauuauggagguugaccgguccgaagcuaaagaggggcugaagagaggagagacaaccaaacacgccgucucucgcggcacagcuaagcugcggugguuuguggaaagaaaucucgugaagccggaggggaaagucaucgaucugggauguggccgcgggggauggagcuacuauugcgccggccuuaagaaaguuaccgaagugaagggcuacacgaaagggggacccggccacgaggaaccuauucccauggcgacauacggguggaaccuggugaagcuccauuccggaaaagacgucuucuuugugccucccgagaagugugauacccugcugugcgacaucggcgagagcucuccuaauccgaccauugaagaggggcggacacucagaguucuuaagaugguggaacccuggcugcgcggaaaccaauucuguaucaaaauucugaauccuuauaugcccuccgucguggagacccucgagcagaugcagcggaagcacggcggcaugcugguuagaaacccucuuagccgcaauucuacacaugaaauguacuggguguccugcgggacgggaaacaucgucagcgccgugaauaugaccucucggaugcugcucaacagauuuacaauggcucaccgcaaacccaccuaugagcgggauguggaccugggcgccgggacaagacacgucgcuguugaaccggagguggccaaccuggauaucauuggacagcgcaucgaaaauauuaagcaugagcacaaauccaccuggcauuacgacgaggauaacccuuauaagacgugggcuuaccacggcagcuaugaagugaagcccuccgggagcgccucuagcauggucaauggagugguuaaacuccugaccaagcccugggacgugaucccuauggucacacaaauugcgaugaccgauacaacccccuucggccagcagagaguguuuaaagagaagguugacacacggaccccuaaagccaagcgcggcacggcucaaaucauggaagugacagccaaguggcuuuggggguuccuguccagaaacaaaaagccgcggaucuguaccagagaggaauuuacccggaaaguccgcucuaaugcugccauuggagccguguucguugacgagaaccaguggaauagcgcgaaggaggcuguggaagaugagagauuuugggaccucguccaucgggaacgcgagcugcacaaacagggcaagugcgccacaugcguguacaacaugauggggaagagagagaagaaacuuggagaguucggcaaagccaaggggucccgggcuaucugguacauguggcugggcgcccgcuuccucgaguuugaagcucugggauucaugaaugaggaucacugguuuucuagagaaaacagccuguccggcgucgagggggagggacuccauaaacugggcuauauucuucgggacaucucuaagauuagcgggggaaauauguacgccgaugacacggcgggcugggauacccgcaucacagaagacgaucugcagaacgaggccaaaaucaccgacauuauggaacccgagcacgcucuccuggccaaguccaucuucaaacuuacauaucaaaauaaagugguuagagugcagcggccugcuaagaacgggaccgucauggaugugauuagccgcagagaccagcggggcucuggacaggugggcacauacgggcugaauaccuuuacgaacauggaagcccaacucauccgccagauggaguccgagggaauuuucagccccucugaacuggagaccccuaaccuggcggaaagagcccucgauuggcuggagaaacauggcguugaacggcuuaagagaauggcuaucuccggggacgacuguguggucaaacccaucgaugaccgcuuugccacagcucugaccgcccucaaugauaugggaaaggugcggaaggacauuccgcagugggagccuagcaaaggcuggaacgauuggcagcaaguucccuucugcucccaccacuuucaucagcugaucaugaaggacgggagagagauuguggucccuugucgcaaucaggaugaacuugugggccgggcuagagucucucagggagccggcuggagccugcgcgagacagcgugccucgggaaauccuaugcccaaauguggcagcugauguacuuccaccggagagaccugcgccucgcugccaacgccaucuguagcgcugugcccguugauugggugccuaccucucggacgacaugguccauucaugcccaccaucaguggaugaccacagaagacaugcugagcgucuggaauagaguguggaucgaggaaaaccccuggauggaggauaagacccacauuucuagcugggaggacguuccguaucuuggaaaacgcgaagaccaauggugcggcucccugaucgggcucacggcgcgggcuaccugggccacaaauauccagguggccauuaaccaggucagacggcugaucggaaaugagaacuaccuugauuacaugaccucuaugaagagauuuaagaaugaaagcgacccugagggcgcucugugguga

SEQ ID NO: 18543 - RNA, 9879 nt, Artificial Sequence
  derived and/or modified CDS sequence (opt5) from DENV-1__FJ639669__SS-prME
agcgugaccaugcugcucaugcugaugcccaccgcccuugcuuuccaccugacgacccggggaggggaaccucauaugaucgucuccaagcaggaacggggaaaaucucuccuguuuaagaccagcgccggcguuaacaugugcacccuuauugcgauggaccugggggaacucugugaagauacaaugaccuacaaaugccccagaaucacagaggcugaacccgacgauguggacuguuggugcaaugccaccgauacgugggugaccuauggaacauguucccaaaccggcgagcaccggcgggacaagcgcucuguugcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggcccaggggaaaaagaugauccggccgcaacccauggaguacaaauauucuuggaaaagcuggggaaaggccaagauuaucggcgcugacgugcagaauaccaccuucaucauugaugggccuaacacacccgaauguccugacgaucagagagcguggaauaucugggaggucgaggacuacggauuuggcauuuucaccacgaacaucuggcugaaacuucgcgauuccuauacacagguuugcgaccaccggcucaugagcgccgcuauuaaagauucuaaggccgugcacgccgacaugggcuacuggaucgaauccgagaaaaaugaaaccuggaagcuggcuagagccagcuuuaucgaggugaagacauguauuuggcccaaaucucauacccugugguccaacgggguccucgaaagcgagaugaucauuccgaagaucuauggaggcccuauuucucaacacaauuaccgccccggguacuucacacagaccgcgggaccuuggcaucugggcaaacuugagcuggauuucgaccucugcgaagggacgaccgugguuguggaugagcacugcggaaaccggggccccagccugagaacaaccacagucaccggcaagaucauccacgaaugguguugccgguccuguacgcugccuccccuucgcuuuagaggggaggacggaugcugguauggcauggagauucggccggugaaagaaaaggaggaaaaucucguuaagagcauggugucugcuggguccggagaggucgacagcuucucccugggccugcucuguaucucuauuaugaucgaagaggugaugagaagccgcuggucccggaaaaugcugaugacagggacccuugccgucuuuuuccugcucauuaugggacagcugacauggaacgaucugaucagacuuugcauuauggugggcgccaaugcuucugaccgcaugggcauggggaccaccuaccuggcccucauggcgacauuuaagaugagaccuauguucgcugucggacugcucuuucggcgccugacgagcagagaggugcuucugcucaccaucggccugucccugguggccucugucgaacuucccaacagccuggaggaacucggggauggacuggccaugggcaucaugauucucaaacugcuuacagacuuccaaucccaucagcugugggcuacccuccugagccugacauuuaucaagaccacguucucucuucacuaugccuggaaaacaauggcuaugguucuguccauugugagccucuuuccccugugucucucuaccaccucccagaagacaaccuggcugccugugcuucuggggagccugggaugcaagccgcucacaauguuccugaucgccgagaauaaaauuuggggccggaagucuuggccccuuaacgaaggcaucauggcggucgggaucguguccauucugcucagcucccugcucaaaaacgauguuccucuggccggaccccuuaucgcuggcgggaugcugauugccuguuacgugaucagcggaucuagcgcugaccugucccucgagaaggccgccgaggucucuugggaagaggaagcugagcauagcggcgcgucccacaauauucugguggaaguucaggaugacgggacgaugaaaaucaaggaugaggagcgcgacgauacccuuacaauccugcucaaagccacccugcucgcugugucuggagucuauccucugagcauucccgccacacuuuuugugugguacuucuggcaaaagaagaaacagagauccggcguccugugggacaccccuucucccccggaaguggagcgggccguucuggaugacggcaucuaucgcauuaugcagagagggcuccugggacggagccaggugggcgucgggguguuccaagaaaacguuuuucauacgauguggcacgugacccgcggagcuguccuuauguaccagggcaagagacuggagccuuccugggccagcgugaaaaaggaccucaucucuuacgggggaggcuggcggcugcagggcuccuggaauacaggggaggaagugcagguuauugcggucgagcccggcaagaacccuaagaaugugcaaaccgcucccggcacauucaagaccccggaaggggaggugggagccaucgcccucgauuuuaaaccuggcacaagcgggucucccauugucaacagagaaggaaagaucgugggccuguauggcaaugggguugugacgaccuccggaacauacgucagcgcuaucgcccaggcgaaggcuucccaggagggcccucuucccgagauugaagacgagguguuccgcaagcggaaccugaccaucauggaucugcaccccgggucuggaaaaaccagacgcuaucucccugccauuguucgggaagccaucaagagaaagcugcgcacacuuauucuggcuccgacgcggguggucgccagcgagauggcugaagcccucaaaggcaugcccaucagauaccaaaccacagcggugaaguccgagcauaccgggaaagagaucguugaccugaugugccacgccacauuuaccaugcgccugcucagcccugugcggguccccaauuauaacaugauuaucauggaugaagcucauuucacggacccuucuuccauugccgcuagaggcuacaucagcacacgggugggaaugggcgaggccgccgcuauuuuuaugaccgcgacacccccugggucuguggaagccuucccgcagagcaaugcugucauccaggaugaggaacgcgacauccccgagagauccuggaacucuggauaugaguggauuacagauuuuccuggcaagaccguuugguucgugcccagcaucaaauccgggaaugacauugccaacugucuucggaagaauggaaagcgcgugauccagcugucuagaaaaacauuugauaccgaauaccaaaagacgaaaaacaacgacugggacuacgucgugacaaccgauauuagcgagaugggcgccaauuuccgggcugacagaguuaucgauccucgccggugccugaagcccgugauucucaaagacgggccggaaagagucauccuggccggcccuaugcccgugacaguugcguccgcugcccagcgccggggaagaaucggccgcaaccacaauaaggagggggaucaguauauuuacaugggacagccccuuaacaaugacgaggaucaugcccacuggaccgaagcuaagaugcugcucgacaacaucaauacgccugagggcauuauccccgcccuguucgaaccugagcgggaaaagagcgcggccauugauggggaguauagacugcgcggagaggcuagaaagaccuuuguggagcucaugcggcgcggcgaccuuccggucuggcugucuuacaaaguggccuccgagggguuccaauauagcgauagacgguggugcuuugacggcgaacgcaacaaucagguccuggaggaaaacauggauguggagaucuggacaaaggagggagaacgcaaaaagcuccggcccagauggcuggacgcucgcaccuacuccgacccucuugcccugcgggaguucaaagaauuugcugccggcagacgcucuguuagcggggaucucauccuggagauuggaaagcugccccagcaccucacacagcgggcgcaaaaugcccuugacaaccuggugaugcugcauaauuccgaacagggcgggagagcuuaucggcacgccauggaggagcucccugauaccaucgaaacacugaugcuucuggcucucauugccgugcugaccggaggcgucacgcuguucuuucucucuggccgcgggcuuggaaagacaagcaucggccugcuguguguuauggccuccagcgugcuccuguggauggcuucuguggagccccauuggauugcggccuccaucauccuugaguucuuucugaugguccuccugauuccggagccugacagacagcggacaccccaggauaaccaacuggcuuacgugguuaucgggcuccuuuucaugauucugaccguggccgccaaugagaugggacugcucgaaacaaccaaaaaggaccugggcaucgggcacgucgcuguggagaaccaccaucacgccgcgaugcuugaugucgaccugcauccugccagcgcuuggacacucuacgccguggcuacgaccauuaucacacccaugaugcgccacaccauugaaaacacaaccgccaauaucucucugacggcgaucgccaaccaggcugccauucugaugggacucgauaaaggcuggccuaucuccaagauggacauuggcguuccccuucuggcucuggggugcuauagccaggugaauccgcucacccugacagccgcuguccuuaugcugguggcccauuacgcgaucauuggaccuggccuccaagccaaagcuaccagagaggcccagaagcggacagcugccgggaucaugaagaaccccaccguugauggaaucguggccauugaccuggaucccgucguguaugacgcgaaauuugaaaagcagcugggccagaucaugcuccuuauucuguguacgucucaaauccugcucaugcgcacaaccugggcucugugcgagagcauuacacuugccaccgggccucugaccacacucugggagggauccccgggcaaauucuggaauacgaccaucgcugugucuauggccaacaucuuuagaggcagcuaccuggccggggcuggacuggccuucucccucaugaaaagccuuggcgggggacggcgcggcacaggggcgcagggagaaacccugggcgagaaauggaagagacagcugaaucagcucuccaagucugaguucaacacauauaaacggagcggcauuauggagguugacagauccgaagccaaggaggggcugaaacgcggagagaccacgaagcacgcugucucucggggcacagccaaacuuagaugguuuguggaacgcaaucuggugaagcccgaggggaaggucaucgaucucggauguggcagagggggauggagcuacuauugcgcuggccugaaaaagguuaccgaagugaaaggcuacaccaaagggggaccuggccacgaggaacccauuccuauggccacauacggguggaaccuggugaaacuccauuccggaaaggacgucuucuuuauucccccugagaaaugugauacccuucugugcgacaucggcgagucuagcccgaaucccacaaucgaagaggggagaacgcugcgcgugcucaagaugguugaaccuuggcugcggggaaaccaauucuguauuaagauccuuaaucccuauaugccuuccguggucgagacccuggagcagaugcagagaaaacacggcggcaugcucgugcgcaacccccugagcagaaauucuacacaugaaauguacuggguuuccugcgggaccggaaacaucgugagcgcggucaauaugacaucuagaaugcugcucaaccgcuuuaccauggcccaccggaagccgacguaugagagagauguggaccugggcaccgggacacgccacguggcugucgaaccugagguugccaaccuugauauuaucggacagagaauugaaaauaucaaacaugagcacaaguccaccuggcauuacgacgaggauaaccccuauaaaacaugggcuuaccacggcagcuaugaagugaagcccucuggguccgccagcuccauggugaauggagucgugaagcugcucaccaaaccuugggacguuauucccauggugacacaaaucgcuaugaccgauacgacaccuuucggccagcagcgggucuuuaaggagaaaguggacacccgcaccccgaaggccaaaagaggcacagcgcaaaucauggaaguuacggcccgguggcuguggggguuccuuagcagaaacaagaagccccggauuuguacccgcgaggaauuuacaagaaaagugcggucuaaugcugccaucggagcugucuucguggacgagaaccaguggaauagcgccaaggaggccguugaagaugagcgcuuuugggaccuggugcauagagaacgggagcuccacaaacagggcaagugcgcgaccugcgucuacaacaugauggggaaacgcgaaaagaagcugggagaguucggcaaagcuaagggguccagagccauuugguacauguggcugggcgcccgguuucucgaguucgaagcucugggauucaugaaugaggaucacugguuuucucgcgaaaacagccuuuccggcguggagggggagggacugcauaaacucggcuauauccugagagacauuucuaagaucccugggggaaauauguacgccgaugacacagcuggcugggauacccggaucacagaagacgaucuucagaacgaggccaaaauuaccgacaucauggaacccgagcacgcgcugcucgccaaggcuauuuucaaacugacguaucaaaauaaggucgugcgcguucagagaccugccaagaacgggaccgugauggaugucaucagccggcgcgaccagagaggcuccggacaggugggcacauacgggcugaauaccuuuacaaacauggaagcucaacucauucggcagauggagucugagggaaucuucagccccuccgaacuggagaccccgaaccuugccgaaagagcgcuggauuggcucgagaaauauggcguggaacgccugaagcggauggccaucagcggggacgacuguguugugaaaccuauugaugacagauuugcuacggcccuuacagcucugaaugauaugggaaagguccgcaaagacaucccccagugggagccuucuaagggcuggaacgauuggcagcaagugcccuucugcucccaucacuuucaccagcucauuaugaaggacgggcgggagaucguugugccuuguagaaaucaggaugaacuggucggccgcgcccgggugagccagggagcuggcuggucucugagagagaccgccugccucgggaaauccuacgcgcaaauguggcagcugauguauuuccaucgccgggaccuuagacuggccgcuaacgccauuuguagcgccguccccguggauuggguuccgacaucccgcaccacguggucuauccacgcucaucaccaguggaugaccacagaagacaugcucagcguguggaaucgggucuggauugaggaaaacccuuggauggaggauaagacccauaucuccagcugggaggacgugcccuaccugggaaaaagagaagaccaauggugcggcucucuuaucgggcugacagcccgggcgaccugggcuacaaauauucagguugccaucaaccaggugagacgccucauuggaaaugagaacuaccuggauuauaugaccuccaugaagcgguuuaaaaaugaaagcgaccccgagggcgcccugugguga

SEQ ID NO: 18544 - RNA, 9882 nt, Artificial Sequence
  derived and/or modified CDS sequence (opt5) from DENV-1__FJ639670__SS-prME
agcgugaccaugcugcucaugcugaugcccaccgcccuugcuuuccaccugacgaccagaggaggggagccucauaugaucguguccaagcaggaacggggaaaaucucuccuguuuaagaccagcgccggcguuaacaugugcacccuuauugcgauggaccugggggagcucugugaagauacaaugaccuacaaaugccccagaaucacagaggcugaacccgacgauguggacuguuggugcaaugccaccgauacgugggugaccuauggaacauguucccaaaccggcgagcaccggcgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggcccaggggaaaaagaugauccggccgcaacccauggaguacaaauauucuuggaaaagcuggggaaaggccaagauuaucggcgcugacgcgcagaauaccaccuucaucauugaugggccuaacacacccgaauguccugacgaucagagagccuggaauaucugggagguggaggacuacggauuuggcauuuucaccacgaacaucuggcugaaacuucgcgauuccuauacacaggucugcgaccaccggcucaugagcgcugccauuaaagauucuaaggccguucacgcugacaugggcuacuggaucgaauccgagaaaaaugaaaccuggaagcuggccagagcgagcuuuaucgaggugaagacauguauuuggcccaaaucucauacccugugguccaacggggugcucgaaagcgagaugaucauuccgaagaucuauggaggcccuauuucucaacacaauuaccgccccggguacuucacacagaccgcuggaccuuggcaucugggcaaacuugagcuggauuucgaccucugcgaagggacgaccgucgugguugaugagcacugcggaaaccggggccccagccugagaacaaccacagugaccggcaagaucauccacgaaugguguugccgguccuguacgcugccuccccuucgcuuuagaggggaggacggaugcugguauggcauggagauucggccggucaaagaaaaggaggaaaaucucgucaagagcaugguuucugccggguccggagagguggacagcuucucccugggccugcucuguaucucuauuaugaucgaagaggucaugagaagccgcuggucccggaaaaugcugaugacagggacccuugccguguuuuuccugcucauuaugggacagcugacauggaacgaucugaucagacuuugcauuaugguuggcgcuaaugccucugaccgcaugggcauggggaccaccuaccuggcgcucauggcuacauuuaagaugagaccuauguucgccgugggacugcucuuucggcgccugacgagcagagagguccuucugcucaccaucggccugucccugguggccucuguggaacuucccaacagccuggaggaacucggggauggacuggcuaugggcaucaugauucucaaacugcuuacagacuuccaaucccaucagcugugggccacccuccugagccugacauuuaucaagaccacguucucucuucacuaugcuuggaaaacaauggccaugguccuguccauuguuagccucuuuccccugugucucucuaccaccucccagaagacaaccuggcugccugugcuucuggggagccugggaugcaagccgcucacaauguuccugaucgcggagaauaaaauuuggggccggaagucuuggccccuuaacgaaggcaucauggccguggggaucgucuccauucugcucagcucccugcucaaaaacgaugugccucuggcuggaccccuuaucgccggcgggaugcugauugcuuguuacguuaucagcggaucuagcgccgaccugucccucgagaaggccgcugaggugucuugggaagaggaagcggagcauagcggcgccucccacaauauucuggucgaagugcaggaugacgggacgaugaaaaucaaggaugaggagcgcgacgauacccuuacaauccugcucaaagcuacccugcucgccguuucuggaguguauccucugagcauucccgccacacuuuuugucugguacuucuggcaaaagaagaaacagagauccggcgugcugugggacaccccuucucccccggaagucgagcgggcugugcuggaugacggcaucuaucgcauuaugcagagagggcuccugggacggagccagguuggcgugggggucuuccaagaaaacguguuucauacgauguggcacguuacccgcggagccgugcuuauguaccagggcaagagacuggagccuuccugggcgagcgucaaaaaggaccucaucucuuacgggggaggcuggcggcugcagggcuccuggaauacaggggaggaaguccaggugauugcuguugagcccggcaagaacccuaagaauguccaaaccgcccccggcacauucaagaccccggaaggggaggugggagccaucgcucucgauuuuaaaccuggcacaagcgggucucccauugugaacagagaaggaaagaucgucggccuguauggcaauggggugguuacgaccuccggaacauacgugagcgccaucgcgcaggcuaaagccucccaggagggcccucuucccgagauugaagacgaggucuuccgcaagcggaaccugaccaucauggaucugcaccccgggucuggaaaaaccagacgcuaucucccugccauugugcgggaagcuaucaagagaaagcugcgcacacuuauucuggccccgacgcggguuguggcuagcgagauggccgaagcgcucaaaggcaugcccaucagauaccaaaccacagccgucaaguccgagcauaccgggaaagagaucguggaccugaugugccacgcuacauuuaccaugcgccugcucagcccuguucgggugcccaauuauaacaugauuaucauggaugaagcccauuucacggacccuucuuccauugcugccagaggcuacaucagcacacgggucggaaugggcgaggccgcugcgauuuuuaugaccgccacacccccugggucuguggaggcuuucccgcagagcaaugccgugauccaggaugaggaacgcgacauccccgagagauccuggaacucuggauaugaguggauuacagauuuuccuggcaagaccgucugguucguucccagcaucaaauccgggaaugacauugccaacugucuucggaagaauggaaagcgcgugauccagcugucuagaaaaacauuugauaccgaauaccaaaagacgaaaaacaacgacugggacuacguggucacaaccgauauuagcgagaugggcgcuaauuuccgggccgacagagugaucgauccucgccggugccugaagcccguuauucucaaagacgggccggaaagagugauccuggcgggcccuaugcccgucacaguggcuuccgccgcccagcgccggggaagaaucggccgcaaccacaauaaggagggggaucaguauauuuacaugggacagccccuuaacaaugacgaggaucaugcucacuggaccgaagccaagaugcugcucgacaacaucaauacgccugagggcauuauccccgcgcuguucgaaccugagcgggaaaagagcgccgcuauugauggggaguauagacugcgcggagaggccagaaagaccuuuguugagcucaugcggcgcggcgaccuuccgguguggcugucuuacaaagucgcuuccgagggguuccaauauagcgauagacgguggugcuuugacggcgaacgcaacaaucaggugcuggaggaaaacauggaugucgagaucuggacaaaggagggagugucccgcaaaaaucuccggcccagauggcuggacgcccgcaccuacucugacccucuugcucugcgggaguucaaggaguuugccgcgggcagacgcagcguuuccggggaucucauccuggaaauuggaaaacugccccagcaccucacacagcgggcccaaaacgcucuugacaaucuggugaugcugcauaacucugagcagggcgggagagccuaucggcacgcuauggaagaacucccugauaccaucgagacacugaugcuucuggcccucauugccgugcugaccggaggcgucacgcuguucuuucucagcggccgcgggcuuggaaagacauccaucggccugcuguguguuauggcuagcucugugcuccuguggauugcguccguggaaccccauuggaucgccgcuagcaucauucuugaguucuuucugaugguccuccugaucccggaaccugacagacagcggacaccccaggauaaucaacuggccuacgugguuauugggcuccuuuucaugauccugaccguggccgcuaacgagaugggacugcucgagacaaccaagaaagaccugggcauugggcacgucgccguggaaaaccaccaucacgcggccaugcuugaugucgaccugcauccugcuucugccuggacacucuacgcuguggccacgaccaucauuacacccaugaugcgccacaccaucgagaauacaaccgcgaacaucucccugacggccauugcuaaucaggccgcuauccugaugggacucgauaagggcuggccuauuagcaaaauggacaucggcguuccccuucuggcccuggggugcuauucucaggugaacccgcucacccugacagcugccguccuuaugcugguggcgcauuacgccauuaucggaccuggccuccaagcuaaggccaccagagaagcucagaaacggacagccgccgggaucaugaagaaucccaccguugauggaauuguggcgaucgaccuggaucccgucguguaugacgcuaaguuugagaaacagcugggccagauuaugcuccuuauccuguguacgagccaaauucugcucaugcgcacaaccugggcccugugcgaauccaucacacuugcuaccgggccucugaccacacucugggagggaucuccgggcaaguucuggaacacgaccaucgccgugagcauggccaauauuuuuagaggcuccuaccuggcuggggccggacuggcguucagccucaugaaaucccuuggcgggggacggcgcggcacaggggcccagggagagacccugggcgaaaaguggaaaagacagcugaaccagcucucuaagagcgaguucaauacauauaagcgguccggcaucauggaaguugacagaucugaggcuaaagaagggcugaagcgcggagagaccacgaaacacgccgucagccggggcacagcuaaacuuagaugguuuguggagcgcaaccuggugaaacccgaagggaaggucauugaucucggauguggcagagggggaugguccuacuauugcgccggccugaagaaaguuaccgaggugaagggcuacaccaaagggggaccuggccacgaagaacccaucccuauggcgacauacggguggaaucuggugaagcuccauucuggaaaagacgucuucuuuauucccccugaaaagugugauacccuucugugcgacaucggcgagagcuccagcaacccgacaauugaggaagggagaacgcugcgcgugcucaaaaugguugagcccuggcugcggggaaaucaauucuguaucaagauccuuaacccuuauaugcccucuguggucgaaacccuggagcagaugcagagaaagcacggcggcaugcucgugcgcaauccucugucccggaacagcacacaugagauguacuggguuucuugcgggaccggaaauauuguguccgccgucaacaugacaagcagaaugcugcucaaccgcuuuaccauggcucaccggaaacccacguaugaaagagauguggaccugggcaccgggacacgccacguggccgucgagccggaaguugcuaaucuugauaucauuggacagagaaucgagaacauuaagcaugaacacaaaucuaccuggcauuacgacgaggauaauccuuauaagacaugggccuaccacggcuccuaugaggugaaacccagcggguccgcuagcucuauggugaacggagucgugaagcugcucaccaagcccugggacguuaucccuauggugacacaaaucgccaugaccgauacgacacccuucggccagcagcgggucuuuaaagaaaagguggacacccgcaccccuaaagcgaagagaggcacagcccaaauuauggagguuacggcucgguggcuguggggguuccuuagcagaaauaaaaagccgcggaucuguacccgcgaagaguuuacaagaaaggugcgguccaacgccgcuauuggagccgucuucguggacgaaaaucaguggaacucugccaaagaggcgguugaggaugaacgcuuuugggaccuggugcauagagagcgggaacuccacaagcagggcaaaugcgcuaccugcgucuacaauaugauggggaagcgcgagaaaaagcugggagaguucggcaaggccaaagggagcagagccaucugguacauguggcugggcgcucgguuucucgaguucgaggcccugggauucaugaacgaagaucacugguuuucccgcgaaaauucucuuagcggcguggaaggggagggacugcauaagcucggcuauauucugagagacaucuccaaaauccccgggggaaacauguacgcugaugacacagccggcugggauacccggauuacagaggacgaucuucagaaugaagcgaagaucaccgacauuauggagccugaacacgcccugcucgcuaaagccaucuucaagcugacguaucaaaacaaagucgugcgcguucagagacccgcuaagaaugggaccgugauggaugucauuucucggcgcgaccagagaggcagcggacaggugggcacauacgggcugaacaccuuuacaaacauggaggcccaacucauccggcagauggaauccgagggaaucuucagcccuucugagcuggaaacccccaaucuugcggagagagcccuggauuggcucgaaaaguauggcguggagcgccugaaacggauggcuauuuccggggacgacuguguugugaagccgaucgaugacagauuugccacggcucuuacagcccugaacgauaugggaaaaguccgcaaggacauuccucagugggaacccagcaaaggcuggaaugauuggcagcaagugccuuucugcucucaucacuuucaccagcucaucaugaaggacgggcgggagauuguugugcccuguagaaaccaggaugagcuggucggccgcgcucgggugucccagggagccggcuggagccugagagaaaccgcgugccucgggaaguccuacgcccaaauguggcagcugauguauuuccaucgccgggaccuuagacuggcugccaaugccaucuguucugcugucccuguggauuggguucccacaagccgcaccacgugguccauucacgcccaucaccaguggaugaccacagaggacaugcucagcguguggaaccgggucuggaucgaagagaauccguggauggaagauaaaacccauaucucuuccugggaggacgugccuuaccugggaaagagagaggaccaauggugcggcagccuuauugggcugacagcgcgggcuaccugggccacaaacauccagguugccauuaaucaggugagacgccucaucggaaacgaaaauuaccuggauuauaugaccucuaugaaacgguuuaagaacgagagcgaccccgaaggcgcucugugguga

SEQ ID NO: 18545 - RNA, 9879 nt, Artificial Sequence
  derived and/or modified CDS sequence (opt5) from DENV-1__FJ639671__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacacugaccuacaaaugcccgcgcaucacagagguggaacccgacgauguggacuguuggugcaauaccacggauaccugggucacauauggaaccuguucccaaacaggcgagcacagacgggacaagcgcucuguggcucuggccccucauguugggcucggacuggagaccagagccgaaacguggaugagcuccgagggcgcuuggaaacagauucagcggguggaaacaugggcccuucgccaccccggcuucaccgucaucgcucuguuucucgcccaugcgauugggacaucuaucacccagaagggaaucauuuucauccugcuuaugcuggugaccccuagcauggccaugagaugcguuggcauugggucccgggauuuuguggagggacucagcggcgcuacaugggucgacguggugcuggagcacgggucuugugucacgaccauggccaaggauaaacccacacuggacaucgaacuccugaagaccgagguuacaaacccugcugugcuucgcaaacugugcauugaagccaagaucuccaauaccacgacagauagcagauguccgacccaaggagaggcgacccucguggaagagcaggacgccaacuucgucugccggcgcacauuuguggauagaggcuggggcaauggguguggacuguucggcaaagggucucuuauuaccugcgcuaaguuuaagugcguuacaaaacuggagggaaagaucgugcaguacgaaaaccucaaauauuccgucaucgugacgguucacaccggcgaccagcaucaaguggggaaugagagcacagaacacggaaccacagccaccauuacgccccaggcuccuaccucugagauccagcugacagacuacggcgcccugacccucgauuguuccccccggacaggccuggacuucaacgaaaugguccuucugaccaugaaggagaaaagcuggcucgugcauaagcagugguuucuggaucuuccucugcccuggacguccggggccucuacaagccaagagaccuggaaucgccaggaccuccuggucacauucaaaaccgcucacgcgaagaagcaggaagugguugugcugggaucccaagagggcgccaugcacaccgcucucacaggggccacggaaauucagaccagcggaacaaccacaaucuuugccggccaucugaaaugcagacuuaagauggauaaacugacccucaaggggaugucuuaugucauguguacgggcuccuucaaacuggagaaggaaguggcugagacacagcacggaaccguucuggugcagauuaaguacgagggcaccgacgccccgugcaaaaucccuuucagcacacaagaugggaagggagucacccagaacggccggcuuaucacagcgaaucccauugugacggacaaagaaaagccugugaacaucgaggcugaaccccccuuuggggagucuuauauuguuaucggagccggcgagaaagcccucaagcugagcugguucaagaaaggguccucuauuggcaagauguuugaagcuaccgccagaggagcucgccggauggccauccugggcgauacagcgugggacuucgggagcgucggaggcguguuuaccuccguggggaaacucguccaucagaucuucggaacagccuacggcgugcuguuuagcgggguuucuuggaccaugaagauuggcaucggagugcuucugacguggcucggccugaauuccagaagcaccucucuguccaugacauguauugcugucgggcuugugacccucuaccugggaguuauggugcaggccgauagcggcugcgucaucaacuggaaagggcgcgagcugaaguguggauccggcauuuucgugacaaaugaaguucacaccuggacagagcaauauaaguuucaggcugacucuccuaaacggcucagcgccgcgaucgggaaggccugggaagagggcgugugcggaauuagauccgcuacccgccuggagaacgucauguggcggcagaucucuaacgaacuuaaucauauccugcucgagaacgacaugaaauucacggugguggucggcgauguuguggggauucuggcccagggaaagaaaaugaucagaccgcaacccauggaacacaaguacagcuggaaauccuggggcaaggcuaagauuaucggggccgacgugcagaauacaaccuuuauuaucgauggaccuaacaccagcgagugucccgacgaucagcgcgccuggaauaucugggaagucgaggacuauggcuucggcauuuuuacaaccaacaucuggcugaaacuucgggauucuuacacgcaggugugcgaccacagacucauguccgcugcgauuaaggauagccgcgccguucaugcugacaugggguauuggaucgagucugaaaaaaaugagacauggaagcuggcccgggccuccuucauugaagugaaaaccuguaucuggccuaagagccacacacuguggucuaacggaguccucgagagcgaaaugaucauucccaagaucuacggcgggccgauuucccaacauaauuauagaccuggauacuucacccagacagcuggccccuggcaccuggggaaacuugagcuggauuuugaccucugcgagggaaccacggugguuguggaugaacacugcggcaaccggggcccuagccugcgcaccacaaccgucacagggaagaucauucaugagugguguugcagaucuuguacccugcccccucuucgguucaaaggagaagacggcugcugguacgggauggagaucagacccgugaaggagaaagaagagaaucucguuaaguccauggugagcgccggauccggcgaagucgacucuuuuagccuggggcugcucuguaucuccauuaugaucgaggaagugaugcgcucucgguggagcagaaagaugcugaugacgggaacacuugcgguguucuuucugcucauuaugggccagcugaccuggaacgaucugauccgccuuugcauuauggucggcgcuaaugccuccgacagaauggggaugggaacaaccuaucuggcccucauggcuaccuucaaaaugcggccgauguuugccguuggccugcucuuccgcagacugacaucucgggaggugcuucugcucacgaucgggcugagccugguggcguccgucgagcuuccuaacagccuggaagagcucggagauggccuggcuauggggauuaugauccucaagcugcuuaccgacuuucaaucuuaccagcugugggccacacuccugucccugaccuucaucaaaacaaccuuuagccuucacuaugccuggaagacgauggcuauggugcugucuauuguuucccuccugccccucugucugagcacaaccucucagaaaaccacauggcuucccgugcugcugggaucccucggcugcaagccucugaccauguuccuuaucgccgaaaauaagauuuggggccgcaaaagcuggccgcugaacgaggggaucauggcugucggaauuguguccauccuccugagcucucuccugaagaacgauguuccccuugccggcccucugaucgcggggggaaugcugauugccuguuacgugaucagcggcuccucugcugaccucagccuggaaaaagccgcugaggucuccugggaggaagaggccgaacauucuggggccagccacaauauucuuguggagguccaggaugacggaacaaugaagaucaaagaugaagagagagacgauacgcugaccauucuccugaaggcuacacuccuggcgguguccggcguuuauccccuuucuaucccugccacccuguuugugugguacuucuggcaaaaaaagaagcagcggagcggcguccugugggacacacccuccccucccgagguggaacgcgcuguucucgaugacgggaucuauagaauuaugcagcggggacugcuuggccgcagccaggugggggucggaguguuccaagagaacguguuucauaccauguggcacguuacgagaggcgccguccugauguaccaggggaaacggcucgaaccgucuugggccuccgugaagaaagaccugaucagcuacggaggcggcuggagacuccaggggucuuggaauaccggagaggaggugcaggucauugcuguggaaccuggcaagaaccccaaaaauguucaaacagccccugggaccuucaagacacccgagggagaagugggcgcgaucgcucuggauuuuaagccggggaccuccggaagcccuauugucaaccgcgagggcaaaaucgugggccuuuaugggaauggaguugugacaacguccggcaccuacgucucugccauugcccaggcuaaggccagccaggaagggccccugccugagaucgaggacgaaguguuccggaaaagaaaccugacaaucauggaucuccaccccggauccggcaagacccgccgguaucugcccgcgauuguuagagaggcuaucaaacgcaagcuucggacccugauucucgccccuacaagaguggucgccagcgaaauggcugaggcccugaaggggaugccgauccgcuaccaaacgaccgcugugaaaucugaacauacaggccgggagauuguggaccugaugugccacgccaccuuuacaaugagacuccuuucccccguccggguuccuaauuauaacaugaucaucauggaugaggcgcauuucaccgaccccagcucuauugccgcucgcggauacaucagcacgagagugggcaugggggaagccgcugccauuuuuaugacagccaccccucccggauccguggaggcuuucccucagucuaaugcggucauccaggaugaagagcgggacauuccggaacgcagcuggaacuccggcuaugaguggaucaccgauuuucccgggaagacagugugguucguuccuucuaucaaaagcggaaaugacauugccaacugucugagaaagaauggcaaacgggugauccagcuguccagaaagaccuuugauacagaguaccaaaagaccaaaaacaacgacugggacuacgucgugacgacagauauuagcgaaaugggggcuaauuuccgcgccgaccggguuaucgaucccagacgcugccucaagccugugauucugaaagacggccccgagcgggucauccuugccggaccgaugccugugaccgucgcuucugccgcgcagagacgcggccggauugggagaaaccacaauaaggaaggagaucaguauaucuacaugggccagccccugaacaaugacgaggaucaugcucacuggacagaggccaaaaugcuccuggacaacaucaauacccccgaagggauuaucccugcccuguucgagcccgaacgcgagaaguccgcugccauugauggagaauauagacuccggggcgaggcgcgcaagacguuuguggagcuuaugagacggggggaccugccuguuuggcugagcuacaaaguggccuccgaaggcuuccaauauucugaucgcagauggugcuuugacggagagcggaacaaucaggugcucgaagagaacauggaugucgaaaucuggaccaaggagggcgagagaaaaaagcugcgcccgcgguggcuugacgcuagaacauacagcgacccccuggcccuccgcgaauucaaagaguuugcugccgggcggagauccguuucuggagaucugauucuggaaaucggcaagcucccucagcaccuuacccagcgggcucaaaaugcccuggacaaccuggugaugcuccauaauagcgagcaggggggacgcgcguauagacacgccauggaagagcugcccgagacaaucgaaacccuuaugcugcucgcucugauugccgugcugacaggcggcgucacccucuucuuucuuuccgggcggggacugggcaaaacgagcaucgggcugcucugugugauggcuucuuccgcccugcuuuggauggccagcguugagccucauuggauugcugcgucuaucauucuggaauucuuucucauggugcugcugauccccgagccggaucgccagagaacaccucaggacaaccaacucgccuacgucgugaucggacuucuguucaugauucugaccgucgcugccaaugagaugggccuccuggaaaccacaaagaaggaucuugggaucggacacguggccguugagaaccaccaucacgcuaccaugcuggacguggaucuccaucccgccuccgcguggacacuguacgccgucgcuacgaccauuaucacaccuaugaugcggcacaccauugaaaacacaaccgccaauaucagccugacggcuauugccaaccaggcggccauccucaugggccuugacaaaggcuggcccaucucuaagauggauauuggggugccucugcuggcucucggaugcuauagccagguuaauccccugacccuuacagccgcugugcugaugcucgucgcccauuacgcuaucauuggcccggggcugcaagccaaagcgacccgcgaggcccagaagagaacagcugccggaaucaugaaaaacccuaccguggacggcauuguggcuaucgaucuggaccccguugucuaugaugccaaguuugaaaagcagcucgggcagaucaugcuucugauucuguguacgucccaaauccuccugaugcggacaaccugggcccuuugcgagucuauuacacuggcgaccggaccccucaccacacugugggagggcagcccuggcaaauucuggaauacgaccaucgcuguguccauggccaacauuuuucgcgggagcuaccuggcuggagccggccucgccuucucccuuaugaagucucuggggggaggcagacgggggacaggagcucagggcgaaacccugggcgagaaauggaagagacagcucaaucagcugagcaaauccgaauucaacacauauaagcgcucugggaucauggagguggaccggagcgaagccaaggagggacuuagacgcggcgagaccacgaaacacgcggucucccgggggacagccaagcugagaugguuuguugaacgcaaucucgugaaaccggagggaaaggugaucgaccugggcugugggcggggaggcuggucuuacuauugcgcuggccugaaaaaggucaccgaagugaagggguacaccaaaggaggccccgggcacgaggaaccuauucccauggccacauacggauggaaccucguuaagcuucauagcggcaaagauguguucuuuaucccucccgagaagugugacacccugcugugcgauauuggggaguccagcccuaauccgacaaucgaagagggaagaacgcuccgcguccugaaaaugguggaacccuggcuucggggcaaccaauucuguauuaagauccugaauccuuauaugcccucuguuguggagacccucgagcagaugcagagaaaacacggcgggaugcugguccgcaacccucugucccggaauagcacacaugaaauguacugggugucuugcggaaccggcaacauuguguccgcugucaauaugacaagcagaaugcuccugaaccgcuuuaccauggcccacagaaagcccacguaugagcgggacguugaucuuggggcgggaacccgccacguggccguggaaccggaggucgcuaaccuggacaucaucggccagagaauugaaaauaucaagcaugagcacaaaucuacauggcauuacgaugaggacaacccuuauaagaccugggccuaccacggguccuaugaagugaaacccagcggauccgcuagcucuaugguuaauggcguggucaagcuccugacaaaacccugggaugugauuccuaugguuacccaaaucgccaugacagacaccacgcccuucggccagcagcggguguuuaaggagaaggucgauacaagaaccccuaaagcuaagcgggggaccgcccaaauuauggaagugacagcgcgcuggcuuuggggauuccugagcagaaacaaaaagccgcggaucuguacgcgcgaggaauuuaccagaaaaguucgguccaaugccgcuaucggcgccguguucgucgacgagaaccaguggaauucugcuaaggaggccguggaagacgagcgcuuuugggaucucguccauagagaacgggagcugcacaagcaggggaaaugcgccacaugcguguacaacaugaugggaaagcgcgaaaaaaagcugggcgaguucgggaaagcgaagggcagcagagcuauuugguacauguggcucggagcccgguuucuggaguucgaagcccuuggcuucaugaaugaggaccacugguuuucccgcgaaaacucucugagcgggguugagggagagggccuccauaagcugggguauauccuuagagauauuuccaaaauccccggaggcaauauguacgcugacgauaccgccgggugggacacacggauuaccgaagaugaccugcagaacgaggcuaagaucacagauaucauggaaccugagcacgcccuccuggcgaccucuauuuucaaacugacguaucaaaauaaggugguccgcgugcagagacccgccaaaaacggcaccgugauggacguuaucagccggagagaucagcgcggauccggccagguggggacauacggacucaauaccuuuacaaacauggaagcucaacugauucggcagauggagagcgagggcaucuucucuccuuccgaacuugagacccccaaccuggccgaaagaguccucgacuggcuggagaaguaugggguggaacgccuuaaacggauggcuauuagcggagaugacuguguugugaagccgaucgacgauagauuugccacggcgcugacagcccucaaugacaugggcaagguccgcaaagauaucccucagugggagcccucuaagggguggaacgacuggcagcaagugccuuucugcucccaucacuuucaccagcugauuaugaaagauggccgggagaucgucgugcccuguagaaaucaggacgaacugguuggacgcgcucgggugagccagggcgccggguggucccucagagagaccgcuugccugggaaagucuuacgcccaaauguggcagcuuauguauuuccaucgccgggaucugagacucgcugccaacgcgauuuguagcgccgucccuguggacuggguucccacaucccggaccacguggagcauccacgcucaucaccaguggaugaccacagaagauaugcugucuguguggaauagagucuggauugaggaaaacccguggauggaggacaaaacccauaucuccagcuggggcgaugugccuuaccuugggaagcgcgaggaccaauggugcggaucucugauuggccucacagcccgggccaccugggcuacaaauauccagguggccaucaaccagguuagacgccugauugggaaugaaaacuaccuggacuauaugaccagcaugaagagauuuaaaaaugaguccgaucccgaaggcgcgcucugguga

SEQ ID NO: 18546 - RNA, 9879 nt, Artificial Sequence
  derived and/or modified CDS sequence (opt5) from DENV-1__JN819423__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacacugaccuacaaaugcccgcgcaucacagagguggaacccgacgauguggacuguuggugcaauaccacggauaccugggucacauauggaaccuguucccaaacaggcgagcacagacgggacaagcgcucuguggcucuggccccucauguugggcucggacuggagaccagagccgaaacguggaugagcuccgagggcgcuuggaaacagauucagcggguggaaacaugggcccuucgccaccccggcuucaccgucaucgcucuguuucucgcccaugcgauugggacaucuaucacccagaagggaaucauuuucauccugcuuaugcuggugaccccuagcauggccaugagaugcguuggcauugggucccgggauuuuguggagggacucagcggcgcuacaugggucgacguggugcuggagcacgggucuugugucacgaccauggccaaggauaaacccacacuggacaucgaacuccugaagaccgagguuacaaacccugcugugcuucgcaaacugugcauugaagccaagaucuccaauaccacgacagauagcagauguccgacccaaggagaggcgacccucguggaagagcaggacgccaacuucgucugccggcgcacauuuguggauagaggcuggggcaauggguguggacuguucggcaaagggucucuuauuaccugcgcuaaguuuaagugcguuacaaaacuggagggaaagaucgugcaguacgaaaaccucaaauauuccgucaucgugacgguucacaccggcgaccagcaucaaguggggaaugagagcacagaacacggaaccacagccaccauuacgccccaggcuccuaccucugagauccagcugacagacuacggcgcccugacccucgauuguuccccccggacaggccuggacuucaacgaaaugguccuucugaccaugaaggagaaaagcuggcucgugcauaagcagugguuucuggaucuuccucugcccuggacguccggggccucuacaagccaagagaccuggaaucgccaggaccuccuggucacauucaaaaccgcucacgcgaagaagcaggaagugguugugcugggaucccaagagggcgccaugcacaccgcucucacaggggccacggaaauucagaccagcggaacaaccacaaucuuugccggccaucugaaaugcagacuuaagauggauaaacugacccucaaggggaugucuuaugucauguguacgggcuccuucaaacuggagaaggaaguggcugagacacagcacggaaccguucuggugcagauuaaguacgagggcaccgacgccccgugcaaaaucccuuucagcacacaagaugggaagggagucacccagaacggccggcuuaucacagcgaaucccauugugacggacaaagaaaagccugugaacaucgaggcugaaccccccuuuggggagucuuauauuguuaucggagccggcgagaaagcccucaagcugagcugguucaagaaaggguccucuauuggcaagauguuugaagcuaccgccagaggagcucgccggauggccauccugggcgauacagcgugggacuucgggagcgucggaggcguguuuaccuccguggggaaacucguccaucagaucuucggaacagccuacggcgugcuguuuagcgggguuucuuggaccaugaagauuggcaucggagugcuucugacguggcucggccugaauuccagaagcaccucucuguccaugacauguauugcugucgggcuugugacccucuaccugggaguuauggugcaggccgauagcggcugcgucaucaacuggaaagggcgcgagcugaaguguggauccggcauuuucgugacaaaugaaguucacaccuggacagagcaauauaaguuucaggcugacucuccuaaacggcucagcgccgcgaucgggaaggccugggaagagggcgugugcggaauuagauccgcuacccgccuggagaacgucauguggcggcagaucucuaacgaacuuaaucauauccugcucgagaacgacaugaaauucacggugguggucggcgauguuguggggauucuggcccagggaaagaaaaugaucagaccgcaacccauggaacacaaguacagcuggaaauccuggggcaaggcuaagauuaucggggccgacgugcagaauacaaccuuuauuaucgauggaccuaacaccagcgagugucccgacgaucagcgcgccuggaauaucugggaagucgaggacuauggcuucggcauuuuuacaaccaacaucuggcugaaacuucgggauucuuacacgcaggugugcgaccacagacucauguccgcugcgauuaaggauagccgcgccguucaugcugacaugggguauuggaucgagucugaaaaaaaugagacauggaagcuggcccgggccuccuucauugaagugaaaaccuguaucuggccuaagagccacacacuguggucuaacggaguccucgagagcgaaaugaucauucccaagaucuacggcgggccgauuucccaacauaauuauagaccuggauacuucacccagacagcuggccccuggcaccuggggaaacuugagcuggauuuugaccucugcgagggaaccacggugguuguggaugaacacugcggcaaccggggcccuagccugcgcaccacaaccgucacagggaagaucauucaugagugguguugcagaucuuguacccugcccccucuucgguucaaaggagaagacggcugcugguacgggauggagaucagacccgugaaggagaaagaagagaaucucguuaaguccauggugagcgccggauccggcgaagucgacucuuuuagccuggggcugcucuguaucuccauuaugaucgaggaagugaugcgcucucgguggagcagaaagaugcugaugacgggaacacuugcgguguucuuucugcucauuaugggccagcugaccuggaacgaucugauccgccuuugcauuauggucggcgcuaaugccuccgacagaauggggaugggaacaaccuaucuggcccucauggcuaccuucaaaaugcggccgauguuugccguuggccugcucuuccgcagacugacaucucgggaggugcuucugcucacgaucgggcugagccugguggcguccgucgagcuuccuaacagccuggaagagcucggagauggccuggcuauggggauuaugauccucaagcugcuuaccgacuuucaaucuuaccagcugugggccacacuccugucccugaccuucaucaaaacaaccuuuagccuucacuaugccuggaagacgauggcuauggugcugucuauuguuucccuccugccccucugucugagcacaaccucucagaaaaccacauggcuucccgugcugcugggaucccucggcugcaagccucugaccauguuccuuaucgccgaaaauaagauuuggggccgcaaaagcuggccgcugaacgaggggaucauggcugucggaauuguguccauccuccugagcucucuccugaagaacgauguuccccuugccggcccucugaucgcggggggaaugcugauugccuguuacgugaucagcggcuccucugcugaccucagccuggaaaaagccgcugaggucuccugggaggaagaggccgaacauucuggggccagccacaauauucuuguggagguccaggaugacggaacaaugaagaucaaagaugaagagagagacgauacgcugaccauucuccugaaggcuacacuccuggcgguguccggcguuuauccccuuucuaucccugccacccuguuugugugguacuucuggcaaaaaaagaagcagcggagcggcguccugugggacacacccuccccucccgagguggaacgcgcuguucucgaugacgggaucuauagaauuaugcagcggggacugcuuggccgcagccaggugggggucggaguguuccaagagaacguguuucauaccauguggcacguuacgagaggcgccguccugauguaccaggggaaacggcucgaaccgucuugggccuccgugaagaaagaccugaucagcuacggaggcggcuggagacuccaggggucuuggaauaccggagaggaggugcaggucauugcuguggaaccuggcaagaaccccaaaaauguucaaacagccccugggaccuucaagacacccgagggagaagugggcgcgaucgcucuggauuuuaagccggggaccuccggaagcccuauugucaaccgcgagggcaaaaucgugggccuuuaugggaauggaguugugacaacguccggcaccuacgucucugccauugcccaggcuaaggccagccaggaagggccccugccugagaucgaggacgaaguguuccggaaaagaaaccugacaaucauggaucuccaccccggauccggcaagacccgccgguaucugcccgcgauuguuagagaggcuaucaaacgcaagcuucggacccugauucucgccccuacaagaguggucgccagcgaaauggcugaggcccugaaggggaugccgauccgcuaccaaacgaccgcugugaaaucugaacauacaggccgggagauuguggaccugaugugccacgccaccuuuacaaugagacuccuuucccccguccggguuccuaauuauaacaugaucaucauggaugaggcgcauuucaccgaccccagcucuauugccgcucgcggauacaucagcacgagagugggcaugggggaagccgcugccauuuuuaugacagccaccccucccggauccguggaggcuuucccucagucuaaugcggucauccaggaugaagagcgggacauuccggaacgcagcuggaacuccggcuaugaguggaucaccgauuuucccgggaagacagugugguucguuccuucuaucaaaagcggaaaugacauugccaacugucugagaaagaauggcaaacgggugauccagcuguccagaaagaccuuugauacagaguaccaaaagaccaaaaacaacgacugggacuacgucgugacgacagauauuagcgaaaugggggcuaauuuccgcgccgaccggguuaucgaucccagacgcugccucaagccugugauucugaaagacggccccgagcgggucauccuugccggaccgaugccugugaccgucgcuucugccgcgcagagacgcggccggauugggagaaaccacaauaaggaaggagaucaguauaucuacaugggccagccccugaacaaugacgaggaucaugcucacuggacagaggccaaaaugcuccuggacaacaucaauacccccgaagggauuaucccugcccuguucgagcccgaacgcgagaaguccgcugccauugauggagaauauagacuccggggcgaggcgcgcaagacguuuguggagcuuaugagacggggggaccugccuguuuggcugagcuacaaaguggccuccgaaggcuuccaauauucugaucgcagauggugcuuugacggagagcggaacaaucaggugcucgaagagaacauggaugucgaaaucuggaccaaggagggcgagagaaaaaagcugcgcccgcgguggcuugacgcuagaacauacagcgacccccuggcccuccgcgaauucaaagaguuugcugccgggcggagauccguuucuggagaucugauucuggaaaucggcaagcucccucagcaccuuacccagcgggcucaaaaugcccuggacaaccuggugaugcuccauaauagcgagcaggggggacgcgcguauagacacgccauggaagagcugcccgagacaaucgaaacccuuaugcugcucgcucugauugccgugcugacaggcggcgucacccucuucuuucuuuccgggcggggacugggcaaaacgagcaucgggcugcucugugugauggcuucuuccgcccugcuuuggauggccagcguugagccucauuggauugcugcgucuaucauucuggaauucuuucucauggugcugcugauccccgagccggaucgccagagaacaccucaggacaaccaacucgccuacgucgugaucggacuucuguucaugauucugaccgucgcugccaaugagaugggccuccuggaaaccacaaagaaggaucuugggaucggacacguggccguugagaaccaccaucacgcuaccaugcuggacguggaucuccaucccgccuccgcguggacacuguacgccgucgcuacgaccauuaucacaccuaugaugcggcacaccauugaaaacacaaccgccaauaucagccugacggcuauugccaaccaggcggccauccucaugggccuugacaaaggcuggcccaucucuaagauggauauuggggugccucugcuggcucucggaugcuauagccagguuaauccccugacccuuacagccgcugugcugaugcucgucgcccauuacgcuaucauuggcccggggcugcaagccaaagcgacccgcgaggcccagaagagaacagcugccggaaucaugaaaaacccuaccguggacggcauuguggcuaucgaucuggaccccguugucuaugaugccaaguuugaaaagcagcucgggcagaucaugcuucugauucuguguacgucccaaauccuccugaugcggacaaccugggcccuuugcgagucuauuacacuggcgaccggaccccucaccacacugugggagggcagcccuggcaaauucuggaauacgaccaucgcuguguccauggccaacauuuuucgcgggagcuaccuggcuggagccggccucgccuucucccuuaugaagucucuggggggaggcagacgggggacaggagcucagggcgaaacccugggcgagaaauggaagagacagcucaaucagcugagcaaauccgaauucaacacauauaagcgcucugggaucauggagguggaccggagcgaagccaaggagggacuuagacgcggcgagaccacgaaacacgcggucucccgggggacagccaagcugagaugguuuguugaacgcaaucucgugaaaccggagggaaaggugaucgaccugggcugugggcggggaggcuggucuuacuauugcgcuggccugaaaaaggucaccgaagugaagggguacaccaaaggaggccccgggcacgaggaaccuauucccauggccacauacggauggaaccucguuaagcuucauagcggcaaagauguguucuuuaucccucccgagaagugugacacccugcugugcgauauuggggaguccagcccuaauccgacaaucgaagagggaagaacgcuccgcguccugaaaaugguggaacccuggcuucggggcaaccaauucuguauuaagauccugaauccuuauaugcccucuguuguggagacccucgagcagaugcagagaaaacacggcgggaugcugguccgcaacccucugucccggaauagcacacaugaaauguacugggugucuugcggaaccggcaacauuguguccgcugucaauaugacaagcagaaugcuccugaaccgcuuuaccauggcccacagaaagcccacguaugagcgggacguugaucuuggggcgggaacccgccacguggccguggaaccggaggucgcuaaccuggacaucaucggccagagaauugaaaauaucaagcaugagcacaaaucuacauggcauuacgaugaggacaacccuuauaagaccugggccuaccacggguccuaugaagugaaacccagcggauccgcuagcucuaugguuaauggcguggucaagcuccugacaaaacccugggaugugauuccuaugguuacccaaaucgccaugacagacaccacgcccuucggccagcagcggguguuuaaggagaaggucgauacaagaaccccuaaagcuaagcgggggaccgcccaaauuauggaagugacagcgcgcuggcuuuggggauuccugagcagaaacaaaaagccgcggaucuguacgcgcgaggaauuuaccagaaaaguucgguccaaugccgcuaucggcgccguguucgucgacgagaaccaguggaauucugcuaaggaggccguggaagacgagcgcuuuugggaucucguccauagagaacgggagcugcacaagcaggggaaaugcgccacaugcguguacaacaugaugggaaagcgcgaaaaaaagcugggcgaguucgggaaagcgaagggcagcagagcuauuugguacauguggcucggagcccgguuucuggaguucgaagcccuuggcuucaugaaugaggaccacugguuuucccgcgaaaacucucugagcgggguugagggagagggccuccauaagcugggguauauccuuagagauauuuccaaaauccccggaggcaauauguacgcugacgauaccgccgggugggacacacggauuaccgaagaugaccugcagaacgaggcuaagaucacagauaucauggaaccugagcacgcccuccuggcgaccucuauuuucaaacugacguaucaaaauaaggugguccgcgugcagagacccgccaaaaacggcaccgugauggacguuaucagccggagagaucagcgcggauccggccagguggggacauacggacucaauaccuuuacaaacauggaagcucaacugauucggcagauggagagcgagggcaucuucucuccuuccgaacuugagacccccaaccuggccgaaagaguccucgacuggcuggagaaguaugggguggaacgccuuaaacggauggcuauuagcggagaugacuguguugugaagccgaucgacgauagauuugccacggcgcugacagcccucaaugacaugggcaagguccgcaaagauaucccucagugggagcccucuaagggguggaacgacuggcagcaagugccuuucugcucccaucacuuucaccagcugauuaugaaagauggccgggagaucgucgugcccuguagaaaucaggacgaacugguuggacgcgcucgggugagccagggcgccggguggucccucagagagaccgcuugccugggaaagucuuacgcccaaauguggcagcuuauguauuuccaucgccgggaucugagacucgcugccaacgcgauuuguagcgccgucccuguggacuggguucccacaucccggaccacguggagcauccacgcucaucagcaauggaugaccacagaagauaugcugucuguguggaauagagucuggauugaggaaaacccguggauggaggacaaaacccacaucuccagcuggggcgaugugccuuaccuugggaagcgcgaggaccaguggugcggaucucugauuggccucacagcccgggccaccugggcuacaaauauccagguggccaucaaccagguuagacgccugauugggaaugaaaacuaccuggacuauaugaccagcaugaagagauuuaaaaaugaguccgaucccgaaggcgcgcucugguga

SEQ ID NO: 18547 - RNA, 9879 nt, Artificial Sequence
  derived and/or modified CDS sequence (opt5) from DENV-1__FJ639672__SS-prME
agcgugaccaugcugcucaugcugaugcccaccgcccuugcuuuccaccugacgacccggggaggggaaccucauaugaucguguccaagcaggaacgggggaaaucucuccuguuuaagaccagcgccggcguuaauaugugcacccuuauugcgauggaccugggggagcucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauuuccagccgggauuuuguugaggggcugucuggagccacauggguggacgucgugcucgagcacggcuccugugugacgaccauggcuaaggauaaacccacacuggacaucgaacugcucaagaccgaggucacaaacccugccguucugcgcaaacuuugcauugaagcgaagaucagcaauaccacgacagauucuagauguccgacccaaggggaggccacccugguggaagaacaggacgcuaacuucgugugccggcgcacauuugucgauagaggauggggcaauggcuguggacucuucggaaaaggcucccugauuaccugcgccaaguuuaagugcgugacaaaacuugaggggaagaucguucaguacgaaaaccugaaauauagcgugaucgucacggugcacaccggagaccagcaucaaguuggcaaugagucuacagaacacgggaccacagcuaccauuacgccccaggccccuaccacagagauccagcucaccgacuacggagcccugacacuggauuguagcccccggaccggccucgacuucaacgaaauggugcugcuuacgaugaaggagaaaagcuggcugguccauaagcagugguuucucgaucugccucuucccuggacauccggcgcuucuaccagccaagagacauggaaucgccaggaccugcucgugaccuucaaaaccgcgcacgccaagaagcaggaagucgugguucuggggucccaagagggagcuaugcacacagcccugacgggcgccaccgaaauucagacaagcgggaccacaaccaucuuugcuggacaucucaaaugcagacugaagauggauaaacuuacgcugaagggcaugucuuaugugauguguacaggguccuucaaacucgagaaggaagucgccgagacccagcacggcaccgugcugguucagauuaaguacgagggaacagacgcgccgugcaaaaucccuuucagcacccaagaugaaaagggcgugacacagaacgggcggcugaucacggcuaaucccauugucaccgacaaagagaagccugugaacaucgaagccgagccgcccuuuggagagucuuauauugugaucggcgccggggaaaaagcucuuaagcucagcugguucaagaaaggauccucuauuggcaagauguuugaggccacagcuagaggggcccgccggauggcgauccugggcgauaccgccugggacuucggaagcaucggcgggguuuuuacauccgucggaaaacuggugcaucagauuuucggcaccgcuuacggggugcucuuuagcggagucucuuggacgaugaagaucggcauuggggugcugcuuaccuggcugggccucaauuccagaagcacaucucuguccaugaccuguaucgccguuggacuggugacacuuuaccucggcgucauggugcaggcugauagcgggugcguuauuaacuggaaaggacgcgaacugaaguguggcuccgggaucuucgugaccaaugagguccacacauggaccgaacaauauaaguuucaggccgacucuccuaaacggcugagcgcggccauuggaaaggcuugggaggagggcgugugcgggaucagauccgccacgcgccucgaaaacaucauguggaaacagauuucuaacgagcugaaucauauccuucuggaaaacgacaugaagcucacaguuguggucggcgauguggcuggcauucuggcccagggcaaaaagaugauccggccgcaacccauggaguacaaauauagcuggaaguccugggggaaggccaaaauuaucggagcugacgugcagaauaccaccuucaucauugauggcccuaacacacccgaauguccugacgaucagagagcguggaauaucugggaggucgaggacuacggguuuggaauuuucaccacgaacaucuggcugaaacuucgcgauagcuauacacagguuugcgaccaccggcucaugucugccgcuauuaaagauuccaaggccgugcacgccgacaugggcuacuggaucgaaagcgagaaaaaugaaaccuggaagcuggcuagagccucuuuuaucgaggugaagacauguauuuggcccaaaucccauacccuguggagcaacggcguccucgaaucugagaugaucauuccgaagaucuaugggggaccuauuagccaacacaauuaccgccccggcuacuucacacagaccgcggggccuuggcaucugggaaaacuugagcuggauuucgaccucugcgaaggcacgaccgugguuguggaugagcacugcgggaaccggggacccucccugagaacaaccacagucaccggcaagaucauccacgaaugguguugccggagcuguacgcugccuccccuucgcuuuagaggcgaggacgggugcugguauggaauggagauucggccggugaaagaaaaggaggaaaaucucguuaagucuaugguguccgcuggcagcggggaggucgacuccuucucucugggacugcucuguaucagcauuaugaucgaagaggugaugagaucccgcuggucucggaaaaugcugaugacaggcacccuugccgucuuuuuccugcucauuauggggcagcugacauggaacgaucugaucagacuuugcauuauggugggagccaaugcuagcgaccgcaugggcaugggcaccaccuaccuggcccucauggcgacauuuaagaugagaccuauguucgcugucgggcugcucuuucggcgccugacguccagagaggugcuucugcucaccaucggacugucucugguggccagcgucgaacuucccaacucccuggaggaacucggcgaugggcuggccaugggaaucaugauucucaaacugcuuacagacuuccaaagccaucagcugugggcuacccuccugucucugacauuuaucaagaccacguucucccuucacuaugccuggaaaacaauggcuaugguucugagcauugugucucucuuuccccugugucucuccaccaccagccagaagacaaccuggcugccugugcuucugggcucucuggggugcaagccgcucacaauguuccugaucgccgagaauaaaauuuggggacggaaguccuggccccuuaacgaaggcaucauggcggucggcaucgugagcauucugcucuccagccugcucaaaaacgauguuccucuggccgggccccuuaucgcuggaggcaugcugauugccuguuacgugaucucugggagcuccgcugaccugucucucgagaaggccgccgaggucagcugggaagaggaagcugagcauuccggagcgucucacaauauucugguggaaguucaggaugacggcacgaugaaaaucaaggaugaggagcgcgacgauacccuuacaauccugcucaaagccacccugcucgcugugagcggggucuauccucuguccauucccgccacacuuuuugugugguacuucuggcaaaagaagaaacagagaucuggaguccugugggacaccccuuccccucccgaaguggagcgggccguucuggaugacggcaucuaucgcauuaugcagagaggccuccuggggcggucccaggugggagucggcguguuccaagaaaacguuuuucauacgauguggcacgugacccgcggggcuguccuuauguaccagggaaagagacuggagcccagcugggccucugugaaaaaggaccucaucuccuacggcgggggauggcggcugcagggcagcuggaauacaggcgaggaagugcagguuauugcggucgagcccgggaaaaacccuaagaaugugcaaaccgcucccggaacauucaagaccccggaaggcgaggugggggccaucgcccucgauuuuaaaccuggaacaucuggcucccccauugucaacagagaagggaagaucgugggacuguauggcaauggcguugugacgaccagcgggacauacgucuccgcuaucgcccaggcgaaggcuucucaggagggaccucuucccgagauugaagacgagguguuccgcaagcggaaccugaccaucauggaucugcaccccggcagcgggaaaaccagacgcuaucucccugccauuguucgggaagccaucaagagaaagcugcgcacacuuauucuggcuccgacgcggguggucgccuccgagauggcugaagcccucaaaggaaugcccaucagauaccaaaccacagcggucaagagcgagcauaccggcaaagagaucguugaccugaugugccacgccacauuuaccaugcgccugcucucuccugugcggguccccaauuauaacaugauuaucauggaugaagcucauuucacggacccuuccagcauugccgcuagaggguacaucucuacacgggugggcaugggagaggccgccgcuauuuuuaugaccgcgacacccccuggcagcguggaagccuucccgcaguccaaugcugucauccaggaugaggaacgcgacauccccgagagaucuuggaacagcggguaugaguggauuacagauuuuccuggaaagaccguuugguucgugcccuccaucaaaucuggcaaugacauugccaacugucuucggaagaaugggaagcgcgugauccagcugagcagaaaaacauuugauaccgaauaccaaaagacgaaaaacaacgacugggacuacgucgugacaaccgauauuuccgagaugggagccaauuuccgggcugacagaguuaucgauccucgccggugccugaagcccgugauucucaaagacggcccggaaagagucauccuggccgggccuaugcccgugacaguugcgagcgcugcccagcgccggggcagaaucggacgcaaccacaauaaggagggcgaucaguauauuuacauggggcagccccuuaacaaugacgaggaucaugcccacuggaccgaagcuaagaugcugcucgacaacaucaauacgccugagggaauuauccccgcccuguucgaaccugagcgggaaaaaucugcggccauugauggcgaguauagacugcgcggggaggcuagaaagaccuuuguggaacucaugcggcgcggagaccuuccggucuggcuguccuacaaaguggccagcgagggcuuccaauauuccgauagacgguggugcuuugacggggaacgcaacaaucagguccuggaggaaaacauggauguggagaucuggacaaaggagggcgaacgcaaaaagcuccggcccagauggcuggacgcucgcaccuacucugacccucuugcccugcgggaguucaaagaauuugcugccggaagacgcagcguuuccggcgaucucauccuggagauugggaagcugccccagcaccucacacagcgggcgcaaaaugcccuugacaaccuggugaugcugcauaauucugaacagggaggcagagcuuaucggcacgccauggaggagcucccugauaccaucgaaacacugaugcuucuggcucucauugccgugcugaccgggggagucacgcuguucuuucucagcggccgcggccuugggaagacauccaucggacugcuguguguuauggccagcucugugcuccuguggauggcuuccguggagccccauuggauugcggccagcaucauccuugaguucuuucugaugguccuccugauuccggagccugacagacagcggacaccccaggauaaccaacuggcuuacgugguuaucggccuccuuuucaugauucugaccguggccgccaaugagauggggcugcucgaaacaaccaaaaaggaccugggaaucggccacgucgcuguggagaaccaccaucacgccgcgaugcuugaugucgaccugcauccugccucugcuuggacacucuacgccguggcuacgaccauuaucacacccaugaugcgccacaccauugaaaacacaaccgccaauaucucccugacggcgaucgccaaccaggcugccauucugauggggcucgauaaaggauggccuaucagcaagauggacauuggcguuccccuucuggcucugggcugcuauucucaggugaauccgcucacccugacagccgcuguccuuaugcugguggcccauuacgcgaucauugggccuggacuccaagccaaagcuaccagagaggcccagaagcggacagcugccggcaucaugaagaaccccaccguugaugggaucguggccauugaccuggaucccgucguguaugacgcgaaauuugaaaagcagcugggacagaucaugcuccuuauucuguguacgagccaaauccugcucaugcgcacaaccugggcucugugcgaguccauuacacuugccaccggcccucugaccacacucugggaggggucuccgggaaaauucuggaauacgaccaucgcugugagcauggccaacaucuuuagaggcuccuaccuggccggcgcugggcuggccuucagccucaugaagucccuuggaggcgggcggcgcggaacaggcgcgcagggggaaacccugggagagaaauggaagagacagcugaaucagcucucuaagagcgaguucaacacauauaaacgguccggcauuauggagguugacagaucugaagccaaggagggccugaaacgcggggagaccacgaagcacgcugucagccggggaacagccaaacuuagaugguuuguggaacgcaaucuggugaagcccgagggcaaggucaucgaucucggguguggacggggcgggugguccuacuauugcgcuggacugaaaaagguuaccgaagugaaaggcuacaccaagggcgggccuggacacgaggaacccauuccuauggccacauacggcuggaaccuggugaaacuccauucugggaaggacgcguucuuuauucccccugagaaaugugauacccuucugugcgacaucggagagagcuccccgaaucccacaaucgaagagggcagaacgcugcgcguccucaagaugguggaaccuuggcugcgggggaaccaauucuguauuaagauccuuaaucccuauaugccuagcguuguggagacccuggagcagaugcagagaaaacacggaggcaugcucguccgcaacccccugucuagaaauuccacacaugaaauguacugggugagcugcggcaccgggaacaucguuucugccgugaauaugacauccagaaugcugcucaaccgcuuuaccauggcucaccggaagccgacguaugagagagaugucgaccugggaaccggcacacgccacguggccguggaaccugaggucgcuaaccuugauauuaucgggcagagaauugaaaauaucaaacaugagcacaagagcaccuggcauuacgacgaggauaaccccuauaaaacaugggccuaccacggaucuuaugaaguuaagcccuccggcagcgcuuccagcauggugaaugggguggucaagcugcucaccaaaccuugggacgugauucccaugguuacacaaaucgccaugaccgauacgacaccuuucggacagcagcggguguuuaaggagaaagucgacacccgcaccccgaaggcgaaaagaggcacagcccaaaucauggaagugacggcucgguggcuguggggcuuccuuucuagaaacaagaagccccggauuuguacccgcgaggaauuuacaagaaaaguucggagcaaugccgcuaucggggccguguucgucgacgagaaccaguggaacuccgccaaggaggcgguggaagaugagcgcuuuugggaccugguucauagagaacgggagcuccacaaacagggaaagugcgcuaccugcguguacaacaugaugggcaaacgcgaaaagaagcugggggaguucggaaaagccaagggcucuagagccauuugguacauguggcugggggcucgguuucucgaguucgaagcccugggcuucaugaaugaggaucacugguuuagccgcgaaaacucccuuucuggagucgagggcgaggggcugcauaaacucggauauauccugagagacauuagcaagaucccuggcgggaauauguacgcugaugacacagccggaugggauacccggaucacagaagacgaucuucagaacgaggcgaaaauuaccgacaucauggaacccgagcacgcccugcucgcuaaggccauuuucaaacugacguaucaaaauaaggugguccgcgugcagagaccugcuaagaacggcaccguuauggaugugaucucccggcgcgaccagagagggucuggccaggucggaacauacggccugaauaccuuuacaaacauggaagcccaacucauucggcagauggagagcgaggggaucuucucccccagcgaacuggagaccccgaaccuugcggaaagagcccuggauuggcucgagaaauauggaguggaacgccugaagcggauggcuaucucuggcgacgacugugugguuaaaccuauugaugacagauuugccacggcucuuacagcccugaaugauauggggaaggugcgcaaagacaucccccagugggagccuuccaagggauggaacgauuggcagcaaguccccuucugcagccaucacuuucaccagcucauuaugaaggacggccgggagaucgugguuccuuguagaaaucaggaugaacugguggggcgcgcucgggucucucagggcgccggauggucccugagagagaccgcgugccucggcaaaagcuacgcccaaauguggcagcugauguauuuccaucgccgggaccuuagacuggcugccaacgccauuuguuccgcugugcccgucgauugggugccgacaucucgcaccacguggagcauccacgcccaucaccaguggaugaccacagaagacaugcucuccguuuggaaucggguguggauugaggaaaacccuuggauggaggauaagacccauaucagcucuugggaggacguccccuaccuggggaaaagagaagaccaauggugcggaucccuuaucggccugacagcgcgggcuaccugggccacaaauauucagguggccaucaaccagguuagacgccucauugggaaugagaacuaccuggauuauaugaccagcaugaagcgguuuaaaaaugaaucugaccccgagggagcucugugguga

SEQ ID NO: 18548 - RNA, 9879 nt, Artificial Sequence
  derived and/or modified CDS sequence (opt5) from DENV-1__FJ639673__SS-prME
uccgugaccaugcugcucaugcugaugcccacggcccuugcuuuccaccugacgaccagaggaggggagccucauaugaucguguccaagcaggaacggggaaaaucucuccuguuuaagaccagcgccggcguuaacaugugcacccuuaucgcgauggaccugggggagcucugugaagauacaaugaccuacaaaugcccgcgcaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagcggguggaaacaugggcccugcgccaccccggcuucaccgucaucgcucuuuuucuggcccaugcgauugggacaucuaucacccagaagggaaucauuuucauccuccugaugcuugugaccccuagcauggccaugagaugcguuggcauugggucccgggauuuuguggagggacugagcggcgcuacaugggucgacguggugcucgagcacgggucuugugucacgaccauggccaaggauaaacccacacuggacaucgaacugcucaagaccgagguuacaaacccugcugugcugcgcaaacuuugcauugaagccaagaucuccaauaccacgacagauagcagauguccgacccaaggagaggcgacccugguggaagaacaagacgccaacuucgucugccggcgcacauuuguggauagaggcuggggcaauggguguggacucuucggcaaagggucucugauuaccugcgcuaaguuuaagugcguuacaaaacuugagggaaagaucgugcaguacgaaaaccugaaauauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguagcccccggacaggccucgacuucaacgaaaugguccugcuuaccaugaaggagaaaagcuggcuggugcauaagcagugguuucucgaucugccucuucccuggacguccggggccucuacaagccaagagaccuggaaucgccaggaccugcucgucacauucaaaaccgcucacgcgaagaagcaggaagugguugugcugggaucccaagagggcgccaugcacaccgcucugacaggggccacggaaauucagaccagcggaacaaccacaaucuuugccggccaucucaaaugcagacugaagauggauaaacuuacccugaaggggaugucuuaugucauguguacgggcuccuucaaacucgagaaggaaguggcugagacacagcacggaaccguucuggugcagauuaaguacgagggcaccgacgccccgugcaaaaucccuuucagcacacaagaugaaaagggggucacccagaacggacggcugaucacagcgaaucccauugugacggacaaagagaagccugugaacaucgaagcugagccgcccuuuggcgagucuuauauuguuaucggggccggagaaaaagcccuuaagcucagcugguucaagaaaggcuccucuauugggaagauguuugaggcuaccgccagaggcgcucgccggauggccauccugggagauacagcgugggacuucggcagcaucgggggagucuuuaccuccgugggcaaacuggugcaucagauuuucgggacagccuacggaguccucuuuagcggcgugucuuggaccaugaagaucgggauuggcguucugcuuacguggcugggacucaauuccagaagcaccucucuguccaugacauguaucgcugugggccuggucacccuuuaccucggggugaugguucaggccgauagcggaugcgugauuaacuggaaaggccgcgaacugaaguguggguccggaaucuucgucacaaaugaggugcacaccuggacagaacaauauaaguuucaggcugacucuccuaaacggcugagcgccgcgauuggcaaggccugggaggaggggguuugcggcaucagauccgcuacccgccucgaaaacaucauguggcggcagauuucuaacgagcugaaucauauccuucuggaaaacgacaugaaauucacgguggucgugggagauguggucggcauucucgcccaggggaagaaaaugaucagaccgcaacccauggagcacaaguacagcuggaaauccuggggaaaggcuaagauuaucggcgccgacguucagaauacaaccuuuaucauugaugggccuaacacccccgaauguccugacgaucagcgcgccuggaauaucugggagguggaggacuauggauucggcauuuuuacaaccaacaucuggcugaaacugcgggauagcuacacacaggugugcgaccacagacuuaugucugcugcgauuaaggauuccaaagccguccaugcugacaugggcuauuggaucgaaagcgagaagaaugaaacauggaaacucgcccgcgccucuuucaucgaggugaagaccuguauuuggcccaagucccacacacuguggagcaacgggguucuggaaucugagaugaucauuccgaaaaucuacggaggcccuauuagccaacauaauuaucggcccggguacuucacccagacagcuggaccuuggcaccucggcaagcuggagcuugauuuugaccugugcgaagggaccacgguggucguggaugagcacugcggaaacagaggccccucccuccggaccacaaccguuacaggcaaaaucauccaugaaugguguugccgcagcuguacccugccuccccugagauucaagggggaggacggaugcugguacggcauggagauucggccggugaaagaaaaggaggaaaaucuugucaagucuaugguguccgccgggagcggagagguugacuccuuuucucucggccugcuguguaucagcauuaugaucgaagaggugaugagaucccgcuggucucggaaaaugcucaugacggggacacuggcggucuucuuucuucugauuaugggacagcucaccuggaacgaucugaucagaagcugcauuauggugggcgcuaaugccuccgaccgcaugggcauggggacaaccuaucuggcccuuauggcuaccuucaagaugagaccuauguuugccgugggacuccuguuccggcgccugacaucuagagagguccuccugcuuacgaucggccugagccucguugcguccguggaacugcccaacagccuggaggaacuuggggauggacuggcuaugggcaucaugauucucaaacugcucaccgacuuucaaucuuaccagcugugggccacacuucugucccucaccuucaucaagacaaccuuuagccugcacuaugccuggaaaacgauggcuauggugcugucuauugucucccuucugccccucugucugagcacaaccucucagaagaccacauggcucccugugcugcuugggucccugggaugcaagccgcugaccauguuccucaucgccgagaauaaaauuuggggccggaaguccuggccccugaacgaaggcaucauggcuguugggaucguguccauucuucugagcucucuccugaaaaacgaugucccucucgccggaccccugaucgcgggcgggaugcuuauugccuguuacgugaucagcggauccucugcugaccugagccuggagaaggccgcuguuguguccugggaggaagaggccgaacauucuggcgccagccacaauauucucgucgaggugcaggaugacgggacaaugaaaaucaaggaugaagaacgcgacgauacgcugaccauccuucugaaagcuacacuccuggcggucuccggaguguauccucucucuauucccgccacccuguuuguuugguacuucuggcaaaagaagaaacagagaagcggcgugcuuugggacacaccuagcccucccgaggucgaacgggcugugcuggaugacggcaucuaucgcauuaugcagagagggcugcucggacggagccagguuggcgugggggucuuccaagagaacguguuucauaccauguggcacgugacgcgcggagccguucugauguaccagggcaagagacuugaacccucuugggccuccgucaaaaaggaccugaucagcuacgggggaggcuggcggcuccagggcucuuggaauaccggggaggagguccaggugauugcugucgaacccggcaagaauccuaagaaugugcaaacagcccccggcaccuucaagacaccggagggggaaguuggagcgaucgcucuggauuuuaaaccuggcaccuccgggagccccauugugaacagagagggaaagaucgucggccucuauggcaauggggugguuacaacguccggaaccuacgugucugccaucgcccaggcuaaagccagccaggaaggcccucugcccgagauugaggacgaagucuuccgcaagcggaaccuuacaaucauggaucugcaccccggguccggaaaaaccagacgcuaucugccugcgauugugcgggaggcuaucaagagaaagcuccgcacccugauucuugccccgacacggguuguggccagcgaaauggcugaggcccugaaaggcaugcccaucagauaccaaacgaccgcugucaagucugaacauacagggcgcgagaucguggaccucaugugccacgccaccuuuacaaugcggcugcuguccccugugagaguccccaauuauaacaugauuaucauggaugaggcgcauuucaccgacccuagcucuauugccgcucggggcuacaucagcacgcgcguuggaaugggcgaagccgcugccauuuuuaugacagccacacccccuggguccguggaggcuuucccgcagucuaaugcggugauccaggaugaagagagagacauccccgaacggagcuggaacuccggauaugaguggauuaccgauuuuccuggcaaaacagucugguucgugcccucuaucaagagcgggaaugacauugccaacugucuccgcaaaaauggaaagagaguuauccagcuuucccggaagaccuuugauacagaguaccagaaaaccaagaacaacgacugggacuacguggucacgacagauauuagcgaaaugggcgcuaauuucagagccgaccgcgugaucgauccucggagaugccugaaacccguuauucugaaggacgggccggagcgcgugauccucgccggcccuaugcccgucaccguggcuucugccgcgcagcggagaggacgcaucggccggaaccacaauaaagaaggggaucaguauauuuacaugggacagccccugaacaaugacgaggaucaugcucacuggacagaggccaagaugcuucuggacaacaucaauaccccugaaggcauuauccccgcccucuucgagccugaaagagagaaguccgcugccauugauggggaauaucgccugagaggagaggcgcggaaaacguuugucgagcugaugcgcagaggcgaccucccgguguggcuuagcuacaagguugccuccgaaggguuccaauauucugaucggcgcuggugcuuugacggcgagagaaacaaucaggugcuggaagagaacauggauguggaaaucuggaccaaagagggagagcggaagaaacugagaccccgcuggcucgacgcucggacauacagcgacccucuggcccuuagagaguucaaggaguuugcugccggccgccgguccgucucuggggaucugauccucgaaauuggaaaacugccccagcaccugacccagagagcucaaaaugcccucgacaaccuuguuaugcugcauaauagcgagcagggcgggcgggcguaucgccacgccauggaggaacugccugauacaaucgagacccucaugcugcuugcucugauugccgugcucacaggaggcgugacccuguucuuucuguccggcagagggcucggaaagacgagcaucggccuucugugugucauggcuucuuccgcccugcucuggauggccagcguggaaccccauuggauugcugcgucuaucauccuggaguucuuucuuaugguucugcucauuccggaaccugaccggcagcgcacaccccaggauaaccaacuggccuacguggucaucgggcuccuguucaugauucuuaccguggcugccaaugagaugggacugcuggagaccacaaagaaagaccucggcaucgggcacgucgccguggaaaaccaccaucacgcuaccaugcuggauguugaccuucauccugccuccgcguggacacuguacgccguggcuacgaccauuaucacacccaugaugagacacaccauugagaacacaaccgccaauaucagccucacggcuaucgccaaccaggcggccauucugaugggacuggauaagggcuggccuaucucuaaaauggacauuggcgucccccuccuugcucuggggugcuauagccaggugaauccgcugacccucacagccgcuguucugaugcuuguggcccauuacgcuaucauuggaccuggccugcaagccaaggcgacccgggaagcccagaaacgcacagcugccgggaucaugaagaaccccaccgucgauggaaucguggcuauugaccucgaucccgugguuuaugacgccaaguuugagaaacagcugggccagaucaugcugcucauucuuuguacgucccaaauccugcugaugagaacaaccugggcccucugcgaaucuauuacacuggcgaccgggccucuuaccacacugugggagggaagcccgggcaaguucuggaauacgaccaucgcugucuccauggccaacaucuuucggggcagcuaccucgcuggggccggacuggccuucucccugaugaaaucucucggcgggggacgcagaggcacaggggcucagggagagacccuuggcgaaaaguggaaacggcagcugaaucagcugagcaaguccgaguucaacacauauaagagaucuggcauuauggaaguggaccgcagcgaggccaaagaagggcuccggagaggagagaccacgaagcacgcggugucccgcggcacagccaaacugcggugguuugucgagagaaaucuuguuaagcccgaagggaaagugaucgaucugggauguggccgcgggggauggucuuacuauugcgcuggccucaagaaggugaccgaggucaaaggcuacaccaaagggggaccuggccacgaggaacccauuccuauggccacauacggguggaaccuggugaaacugcauagcggaaaggacguuuucuuuauucccccugaaaaaugugauacccuccuuugcgacauuggcgaguccagcccgaaucccacaaucgaggaagggcggacgcugagagugcugaagauggucgagccuuggcuccgcggaaaccaauucuguauuaaaauccugaaucccuauaugccuucugugguugaaacccuugagcagaugcagcggaagcacggcggcaugcuggugagaaacccccucucccgcaauagcacacaugagauguacugggucucuugcgggaccggaaacaucguguccgcugugaauaugacaagccggaugcugcugaacagauuuaccauggcccaccgcaagccgacguaugaaagagaugucgaccucggcgcggggacccggcacguugccguggagccugaaguggcuaaccuggauauuaucggacagcgcauugagaauaucaaacaugaacacaagucuacauggcauuacgacgaggauaaccccuauaaaaccugggccuaccacggcuccuaugaggucaagcccagcggguccgcuagcucuauggugaauggaguugugaaacuucugacaaagccuugggacgucauucccauggugacccaaaucgccaugacagauaccacgccuuucggccagcagagaguuuuuaaggaaaaaguggacacacggaccccgaaggcuaaaagaggcaccgcccaaaucauggaggucacagcgcgguggcucuggggguuccugagccgcaacaagaaacccagaauuuguacgcgggaagaguuuacccgcaaggugagauccaaugccgcuaucggagccguuuucguggacgaaaaccaguggaacucugcuaaggaggccgucgaggaugaacgguuuugggaccuugugcaucgcgagagagaacugcacaaacagggcaagugcgccacaugcgucuacaacaugauggggaaacgggagaagaaacucggagaguucggcaaggcgaaggggagccgcgcuauuugguacauguggcugggcgccagauuucuggaguucgaggcccucggauucaugaaugaagaucacugguuuucccgggagaacucucugagcggcguggaaggggagggacuucauaaacugggcuauauccuccgcgacauuuccaagaucccugggggaaauauguacgcugaugacaccgccggcugggauacaagaaucaccgaggacgaucugcagaacgaagcuaaaauuacagacaucauggagcccgaacacgcccuucuggcgaccucuauuuucaagcucacguaucaaaauaaaguugugcggguccagcgcccugccaagaacgggaccgugauggaugugaucagcagacgggaccagagaggcuccggacagguuggcacauacgggcugaauaccuuuacaaacauggaggcucaacugauucgccagauggaaagcgagggaaucuucucucccuccgagcucgaaaccccgaaccuggccgagcgggugcuugauuggcuggaaaaauauggcgucgagagacucaagcgcauggcuaucagcggggacgacugugugguuaagccuauugaugaccgguuugccacggcgcugacagcccuuaaugauaugggaaaagugagaaaggacaucccccagugggaaccuucuaaaggcuggaacgauuggcagcaaguccccuucugcucccaucacuuucaccagcugauuaugaaggacgggcgcgagaucguggucccuugucggaaucaggaugagcucgugggcagagcucgcguuagccagggagccggcuggucccugcgggaaaccgcuugccuggggaaaucuuacgcccaaauguggcagcucauguauuuccauagacgcgaccugcggcuugcugccaacgcgauuuguagcgccgugcccgucgauugggugccgacauccagaaccacguggagcauccacgcucaucaccaguggaugaccacagaggacaugcugucuguuuggaaucggguguggauugaagagaacccuuggauggaagauaagacccauaucuccagcuggggagacguccccuaccucggcaagagagaggaccaauggugcgggucucugaucggacuuacagcccgcgccaccugggcuacaaauauucagguggccaucaaccaggugcggagacugauuggcaaugagaacuaccucgauuauaugaccagcaugaaacgcuuuaagaaugaauccgaccccgagggggcgcugugguga

SEQ ID NO: 18549 - RNA, 9879 nt, Artificial Sequence
  derived and/or modified CDS sequence (opt5) from DENV-1__FJ639674__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaugucucucuccaugaccuguaucgccguuggccuggugacacuguaccuuggggucauggugcaggcugauagcggaugcguuauuaacuggaaaggccgcgaacucaaguguggguccggaaucuuugugaccaaugagguccacacauggaccgaacaauauaaguuccaggccgacucuccuaaacggcugagcgcggccauuggcaaggcuugggaggagggggugugcggcaucagauccgccacacgccuggaaaacaucauguggaaacagauuucuaacgagcucaaucauauccugcuugaaaacgacaugaaguuuaccguuguggucggagauguggcuggcauucuggcccaggggaaaaagaugauccggccgcaacccauggaguacaaauauagcuggaaguccuggggaaaggccaaaauuaucggcgcugacgugcagaauacgacauucaucauugaugggccuaacacccccgaauguccugacgaucagagagcguggaauaucugggaggucgaggacuacggauuuggcauuuucaccacaaacaucuggcucaagcugcgcgauagcuauacccagguuugcgaccaccggcugaugucugccgcuauuaaagauuccaaggccgugcacgccgacaugggcuacuggaucgaaagcgagaaaaaugaaacguggaaacuugcuagagccucuuucaucgaggugaagacauguauuuggcccaaaucccauacccucuggagcaacgggguccuggaaucugagaugaucauuccgaagaucuauggaggcccuauuagccaacacaauuaccgccccggguacuuuacacagaccgcgggaccuuggcaucugggcaaacucgagcuggauuucgaccuuugcgaagggacaaccgugguuguggaugagcacugcggaaaccggggccccucccugagaacgaccacagucaccggcaagaucauccacgaaugguguugccggagcuguacacucccuccccugcgcuuuaaaggggaggacggaugcugguauggcauggagauuagaccggugaaggaaaaggaggaaaaucugguuaaaucuaugguguccgcugggagcggagaggucgacuccuucucucuuggccuccuguguaucagcauuaugaucgaagaggugaugcgguccagauggucucgcaagaugcugaugaccgggacgcucgccgucuuuuuccugcuuauuaugggacagcugacauggaacgaucucauccggcugugcauuauggugggcgccaaugcuagcgacagaaugggcauggggaccacauaccuggcccuuauggcgaccuuuaaaaugcgcccuauguucgcugucggacugcucuuuagacggcugaccucccgcgaggugcuccugcuuacaaucggccugucucucguggccagcgucgaacugcccaacucccuggaggaacuuggggauggacuggccaugggcaucaugauucucaagcugcucacggacuuccaaagccaucagcugugggcuacccuucugucucucacauuuaucaaaaccacauucucccugcacuaugccuggaagaccauggcuaugguucugagcauugugucucuuuuuccccugugucucuccacgacaagccagaagaccaccuggcugccugugcuccuggggucucuuggaugcaaaccgcugacaauguuccugaucgccgagaauaagauuuggggcagaaaauccuggccccucaacgaaggcaucauggcggucgggaucgugagcauucugcuuuccagccugcucaagaacgauguuccucuggccggaccccucaucgcuggcgggaugcugauugccuguuacgugaucucuggaagcuccgcugaccuuucucuggagaaagccgccgaggucagcugggaagaggaagcugagcauuccggcgcgucucacaauauucugguggaaguucaggaugacgggaccaugaagaucaaagaugaggagcgggacgauacacucacgauccugcuuaaggccacccugcucgcugugagcggagucuauccucuguccauucccgccacacucuucgugugguacuuuuggcaaaagaaaaagcagcgcucuggcguccugugggacaccccuuccccucccgaaguggagagagccguucuugaugacggcaucuaucggauuaugcagcgcgggcugcugggaagaucccaggugggcgucgggguguuccaagaaaacguuuuucauacaauguggcacgugacccggggagcuguccucauguaccagggcaaacgccuggagcccagcugggccucugugaagaaagaccuuaucuccuacgggggaggcuggagacugcagggcagcuggaauacgggggaggaagugcagguuauugcggucgagcccggaaagaacccuaagaaugugcaaaccgcucccggcacauucaaaaccucugaaggggaggugggagccaucgcccucgauuuuaagccgggcacauccgggagcccuauugucaaccgggaaggaaaaaucgugggccuguauggcaaugggguugugaccacauccggaacguacgucucugcuaucgcccaggcgaaggcuagccaggagggcccccucccugagauugaagacgagguguucagaaaacgcaaccugaccaucauggaucuucaccccggguccggaaagacacggagauaucugcccgccauuguucgcgaagccaucaagcggaaacugagaacccucauucuggcuccuacccgcguggucgccagcgagauggcugaagcccuuaagggcaugccgauccgguaccaaacaacggcggugaaaucugagcauaccgggaaggagaucguugaccugaugugccacgccacauuuaccaugagacuccugucccccgugcgcgucccuaauuauaacaugauuaucauggaugaagcucauuucacagaccccagcucuauugccgcucggggcuacaucagcaccagagugggaaugggcgaggccgccgcuauuuuuaugacggcgacaccucccggguccguggaagccuucccucagucuaaugcugucauccaggaugaggaacgggacaucccggagcgcagcuggaacuccggauaugaguggauuaccgauuuucccggcaaaaccguuugguucgugccuucuaucaagagcgggaaugacauugccaacugucugagaaagaauggaaaacgggugauccagcucucccgcaagacauucgauaccgaauaccagaagacaaagaacaacgacugggacuacgucgugaccacggauauuagcgagaugggcgccaauuuuagagcugaccggguuaucgaucccagacgcugccuuaaaccugugauucugaaggacgggcccgaacgggucauccuggccggcccgaugccugugacaguugcgucugcugcccagagacgcggacggaucggcagaaaccacaauaaggagggggaucaguauauuuacaugggacagccccucaacaaugacgaggaucaugcccacuggaccgaagcuaaaaugcugcuugacaacaucaauacacccgagggcauuaucccugcccuguucgaacccgagcgcgaaaaguccgcggccauugauggggaguaucggcucagaggagaggcucgcaaaaccuuuguggaacugaugagacggggcgaccugccugucuggcucagcuacaagguggccuccgagggguuccaauauucugaucgcagauggugcuuugacggcgaacggaacaaucagguccuugaggaaaacauggauguggagaucuggacgaaagagggagaacgcaagaaacugagaccgcgguggcuggacgcuagaaccuacagcgacccccucgcccugcgcgaguucaaggaauuugcugccggccggagauccguuucuggggaucuuauccuggagauuggaaagcucccucagcaccugacacagcgcgcgcaaaaugcccuggacaaccucgugaugcuucauaauagcgaacagggcgggcgggcuuauagacacgccauggaggagcugcccgauaccaucgaaacacugaugcuccuggcucuuauugccgugcugaccggaggcgucacacucuucuuucuguccggccgggggcugggaaaaaccagcaucggccuccuuuguguuauggccucuuccgugcugcuguggauggcuagcguggagccucauuggauugcggccucuaucauccucgaguucuuucugaugguccuucugauucccgagccggaccgccagagaacgccucaggauaaccaacucgcuuacgugguuaucgggcugcuguucaugauucucacaguggccgccaaugagaugggacuucuggaaaccaccaagaaagaccugggcaucgggcacgucgcuguggagaaccaccaucacgccgcgaugcucgaugucgaccugcaucccgccuccgcuuggacacuuuacgccguggcuaccacaauuaucacgccuaugaugcggcacaccauugaaaacacaaccgccaauaucagccugacagcgaucgccaaccaggcugccauucucaugggacuggauaagggcuggcccaucucuaaaauggacauuggcguuccucugcucgcucuugggugcuauagccaggugaauccccugacccugacggccgcuguccucaugcugguggcccauuacgcgaucauuggaccgggccuucaagccaaggcuacccgcgaggcccagaagagaacagcugccgggaucaugaaaaacccuaccguugauggaaucguggccauugaccuggaucccgucguguaugacgcgaaguuugaaaaacagcucggccagaucaugcugcugauucucuguacaucccaaauccuucugaugcggaccacgugggcucugugcgagucuauuacacucgccaccgggccccugacaacccuuugggagggaagcccuggcaaguucuggaauaccacaaucgcuguguccauggccaacaucuuccgcggcagcuaccuggccggggcuggacucgccuuuucccugaugaaaucucugggcgggggaagacggggcacgggggcgcagggagaaacccucggcgagaaguggaagcgccagcuuaaucagcugagcaaauccgaguucaacacauauaagagaucuggcauuauggagguugaccggagcgaagccaaagaggggcugaagagaggagagaccacaaaacacgcugucucccgcggcaccgccaagcuccggugguuuguggaaagaaaucuggugaagccggaggggaaagucaucgaucuuggauguggccgcgggggauggucuuacuauugcgcuggccugaagaaaguuacggaagugaagggcuacacaaaagggggacccggccacgaggaaccuauucccauggccaccuacggguggaaccucgugaagcugcauagcggaaaagacgucuucuuuaucccucccgagaagugugauacccugcucugcgacauuggcgaguccagcccuaauccgacaaucgaagaggggcggacccuuagagugcugaagaugguugaacccuggcugcgcggaaaccaauucuguauuaaaauccucaauccuuauaugcccucuguggucgagacacuggagcagaugcagcggaagcacggcggcaugcuugugagaaacccucugucccgcaauagcacgcaugaaauguacuggguuucuugcgggaccggaaacaucguguccgcggucaauaugacaagccggaugcuccugaacagauuuaccauggcccaccgcaaacccacauaugagcgggauguggaccugggcgcugggaccagacacguggccgucgaaccggagguugcuaaccucgauauuaucggacagcgcauugaaaauaucaagcaugagcacaaaucuacguggcauuacgacgaggauaacccuuauaagaccugggccuaccacggcuccuaugaagugaagcccagcggguccgcuagcucuauggugaauggagucgugaaacugcuuacaaagcccugggacguuauuccuauggugacccaaaucgccaugacagauaccacacccuucggccagcagagagucuuuaaagagaagguggacacccggacgccuaaagcgaagcgcggcacagcccaaaucauggaaguuaccgcuaaguggcuguggggguuccucagcagaaacaaaaagccgcggauuuguaccagagaggaauuuacacggaaagugcgcuccaaugccgcuaucggagccgucuucguggacgagaaccaguggaacucugccaaggaggcgguugaagaugagagauuuugggaccuggugcaucgggaacgcgagcuucacaaacagggcaagugcgcuacgugcgucuacaacaugauggggaagagagagaagaagcugggagaguucggcaaagccaaggggagccgggccauuugguacauguggcucggcgcucgcuuccuggaguuugaagcccugggauucaugaaugaggaucacugguuuuccagagaaaacucucucagcggcguggagggggagggacugcauaaacuuggcuauauccugcgggacauuuccaagauccccgggggaaauauguacgcugaugacaccgccggcugggauacacgcaucaccgaagacgaucuccagaacgaggcgaaaauuacagacaucauggaaccugagcacgcccugcuugcuaagucuauuuucaagcugaccuaucaaaauaaagucgugagaguucagcggcccgugaagaacgggacagucauggaugugaucagccgcagagaccagcggggcuccggacaggugggcaccuacgggcucaauacguuuaccaacauggaagcccaacugauucgccagauggagagcgagggaaucuucucuccuuccgaacuggagacacccaaccucgcuggcagaguucuggauuggcuugaaaaacaugggguggagcggcugaagagaauggccaucagcggagacgacugugucgugaaaccgauugaugaccgcuuugcgaccgcccucacagcucugaaugauaugggcaagguucggaaggacaucccucagugggaacccucuaaaggguggaacgauuggcagcaagugccuuucugcucccaccacuuucaucagcuuauuaugaaggacggcagagagaucgucgugcccugucgcaaucaggaugagcuggucggacgggccagagugagccagggcgcuggguggucccuccgcgaaaccgccugccugggaaaaucuuaugcucaaauguggcagcugauguacuuccaccggagagaccuccgccuggccgcgaacgccauuuguagcgcuguuccuguggauuggguccccacgucccggacaaccuggagcauccaugcccaccaucaguggaugacaaccgaggacaugcuuucuguguggaauagaguuuggauugaagagaacccguggauggaagauaagacgcacaucuccagcuggggcgacgugccuuaucuggggaaacgcgaggaccaauggugcggaucucucaucggccugaccgcccgggcuacaugggccaccaauauucaggucgcgaucaaccaggugagacggcuuauugggaaugagaacuaccuggauuacaugacaagcaugaagagauuuaagaaugaauccgaccccgagggcgcucucugguga

SEQ ID NO: 18550 - RNA, 9879 nt, Artificial Sequence
  derived and/or modified CDS sequence (opt5) from DENV-1__FJ639675__SS-prME
agcgugaccaugcugcucaugcugaugcccacagcucuugcuuuccaccugacgaccagaggcggggaaccucauaugaucguguccaagcaggaacggggaaaaucucuccuguuuaagacaagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggccuguucaaacucgagaaggaagucgccgagacacagcacggaaccgugcugguucagauuaaguacgagggcaccgacgcgccgugcaaaaucccuuuuuccacacaagaugaaaagggggugacccagaacggacggcugaucacagcuaaucccauugucacggacaaagagaagccugugaacaucgaagccgagccgcccuucggcgagagcuauauugugaucggggccggagaaaaagcucuuaagcucucuugguuuaagaaaggcagcuccauugggaagauguucgaggccaccgcuagaggcgcccgccggauggcgauccugggagauacagccugggacuuuggcucuaucgggggaguuuucaccagcgucggcaaacuggugcaucagauuuuugggacagcuuacggaguccuguucuccggcgucagcuggaccaugaagaucgggauuggcgugcugcuuacguggcugggacucaauucuagauccaccagccugucuaugacauguaucgccguuggccuggugacccuuuaccucggggucauggugcaggcugauuccggaugcguuauuaacuggaaaggccgcgaacugaagugugggagcggaaucuuugugacaaaugagguccacaccuggacagaacaauauaaguuccaggccgacuccccuaaacggcugucuagcgcgauuggcaaggccugggaggagggggugugcggcaucagauccgcuacccgccucgaaaacaucauguggaaacagauuucuaacgagcugaaucauauccuucuggaaaacgacaugaaguuuacgguuguggucggagauguggccggcauucucgcucaggggaaaaagaugauccggccgcaacccauggaguacaaauauagcuggaaguccuggggaaaggccaaaauuaucggcgccgacgugcagaauacaaccuucaucauugaugggccuaacacccccgaauguccugacgaucagagagcuuggaauaucugggaggucgaggacuacggauuuggcauuuucacaaccaacaucuggcugaagcugcgcgauagcuauacgcagguuugcgaccaccggcuuaugucugcggccauuaaagauuccaaggcugugcacgccgacaugggcuacuggaucgaaagcgagaaaaaugaaacauggaagcucgccagagcuucuuucaucgaggugaagaccuguauuuggcccaaaucccauacacuguggagcaacgggguccuggaaucugagaugaucauuccgaagaucuauggaggcccuauuagccaacacaauuaccgccccggguacuuuacccagacagccggaccuuggcaucucggcaaacuggagcuugauuucgaccugugcgaagggaccacggugguuguggaugagcacugcggaaaccggggccccucccucagaaccacaaccgucacaggcaagaucauccacgaaugguguugccggagcuguacccugccuccccugcgcuuuaaaggggaggacggaugcugguauggcauggagauuagaccggugaaggaaaaggaggaaaaucuuguuaaaucuaugguguccgcggggagcggagaggucgacuccuucucucucggccugcuguguaucagcauuaugaucgaagaggugaugcgguccagauggucucgcaagaugcucaugacggggacacuggcugucuuuuuccuucugauuaugggacagcucaccuggaacgaucugauccggcugugcauuauggugggcgccaaugccagcgacagaaugggcauggggaugacauaccuugcucugauggccaccuuuaaaaugcgcccuauguucgcggucggacuccuguuuagacggcucaccucccgcgaggugcugcuucugacaaucggccucucucugguggcuagcgucgaacugcccaacucccuugaggaacugggggauggacucgccaugggcaucaugauucugaagcuccugacggacuuccaaagccaucagcuuugggccacccugcucucucugacauuuaucaaaaccacauucucccugcacuaugcuuggaagaccauggccaugguucuuagcauugugucucuguuuccccucugucuguccacgacaagccagaagaccaccuggcucccugugcugcuugggucucugggaugcaaaccgcugacaauguuccucaucgcugagaauaagauuuggggcagaaaauccuggccccugaacgaaggcaucauggccgucgggaucgugagcauucuucuguccagccuccugaagaacgauguuccucucgcgggaccccugaucgccggcgggaugcuuauugcuuguuacgugaucucuggaagcuccgccgaccugucucuggagaaagcugccgaggucagcugggaagaggaagccgagcauuccggcgcuucucacaauauucucguggaaguucaggaugacgggaccaugaagaucaaagaugaggagcgggacgauacacugacgauccuucugaaggcgacccuccuggccgugagcggagucuauccucucuccauucccgcuacacuguucgugugguacuuuuggcaaaagaaaaagcagcgcucuggcguccuuugggacaccccuuccccucccgaaguggagagagccguucuggaugacggcaucuaucggauuaugcagcgcgggcugcucggaagaucccaggugggcgucgggguguuccaagaaaacguuuuucauacaauguggcacgugacccggggagccguccugauguaccagggcaaacgccuugagcccagcugggcuucugugaagaaagaccugaucuccuacgggggaggcuggagacuccagggcagcuggaauacgggggaggaagugcagguuauugccgucgagcccggaaagaacccuaagaaugugcaaaccgcgcccggcacauucaaaaccucugaaggggaggugggagcuaucgcccuggauuuuaagccgggcacauccgggagcccuauugucaaccgggaaggaaaaaucgugggccucuauggcaaugggguugugaccacauccggaacguacgucucugccaucgcucaggccaaggcgagccaggagggcccccugccugagauugaagacgagguguucagaaaacgcaaccuuaccaucauggaucugcaccccggguccggaaagacacggagauaucugcccgcuauuguucgcgaagccaucaagcggaaacucagaacccugauucuugccccuacccgcguggucgcuagcgagauggccgaagcucugaagggcaugccgauccgguaccaaacaacggccgugaaaucugagcauaccgggaaggagaucguugaccucaugugccacgcgacauuuaccaugagacugcugucccccgugcgcgucccuaauuauaacaugauuaucauggaugaagcccauuucacagaccccagcucuauugcugcccggggcuacaucagcaccagagugggaaugggcgaggcugccgccauuuuuaugacggcuacaccucccggguccguggaagcguucccucagucuaaugccgucauccaggaugaggaacgggacaucccggagcgcagcuggaacuccggauaugaguggauuaccgauuuucccggcaaaaccguuugguucgugccuucuaucaagagcgggaaugacauugcuaacugucucagaaagaauggaaaacgggugauccagcuuucccgcaagacauucgauaccgaauaccagaaaacaaagaacaacgacugggacuacgucgugaccacggauauuagcgagaugggcgccaauuuuagagccgaccggguuaucgaucccagacgcugccugaaaccugugauucugaaggacgggcccgaacgggucauccucgcuggcccgaugccugugacaguugccucugcggcucagagacgcggacggaucggcagaaaccacaauaaggagggggaucaguauauuuacaugggacagccccugaacaaugacgaggaucaugcccacuggaccgaagccaaaaugcuucuggacaacaucaauacacccgagggcauuaucccugcucucuucgaacccgagcgcgaaaaguccgccgcgauugauggggaguaucggcugagaggagaggcccgcaaaaccuuuguggaacugaugagacggggcgaccucccugucuggcuuagcuacaagguggcuuccgagggguuccaauauucugaucgcagauggugcuuugacggcgaacggaacaaucagguccuggaggaaaacauggauguggagaucuggacgaaagagggagaacgcaagaaacugagaccgcgguggcucgacgccagaaccuacagcgacccccuggcccuucgcgaguucaaggaauuugccgcuggccggagauccguuucuggggaucugauccucgagauuggaaagcugccucagcaccugacacagcgcgcccaaaaugcgcucgacaaccuugugaugcugcauaauagcgaacagggcgggcgggccuauagacacgcuauggaggagcugcccgauaccaucgaaacacucaugcugcuugcccugauugcugugcucaccggaggcgucacacuguucuuucuguccggccgggggcucggaaaaaccagcaucggccuucuguguguuauggccucuuccgugcugcucuggauggccagcguggagccucauuggauugcugcgucuaucauccuggaguucuuucuuaugguccugcucauucccgagccggaccgccagagaacgccucaggauaaccaacuggccuacgugguuaucgggcuccucuucaugauucuuacaguggcugccaaugagaugggacugcuggaaaccaccaagaaagaccucggcaucgggcacgucgccguggagaaccaccaucacgcugccaugcuggaugucgaccuucaucccgcguccgccuggacacuguacgcuguggccaccacaauuaucacgccuaugaugcggcacaccauugaaaacacaaccgcuaauaucagccucacagccaucgcgaaccaggccgcuauucugaugggacuggauaagggcuggcccaucucuaaaauggacauuggcguuccucuccuugcccuggggugcuauagccaggugaauccccugacccucacggcugccguccugaugcuuguggcucauuacgccaucauuggaccgggccugcaagcgaaggccacccgcgaggcucagaagagaacagccgcugggaucaugaaaaacccuaccguugauggaaucguggccauugaccucgaucccgucguguaugacgccaaguuugaaaaacagcugggccagaucaugcugcucauucuuuguacaucccaaauccugcugaugcggaccacgugggcgcucugcgagucuauuacacuggcuaccgggccccuuacaacccugugggagggaagcccuggcaaguucuggaauaccacaaucgccguguccauggcuaacaucuuccgcggcagcuaccucgccggggccggacuggcuuuuucccugaugaaaucucucggcgggggaagacggggcacgggggcccagggagaaacccuuggcgagaaguggaagcgccagcugaaucagcugagcaaauccgaguucaacacauauaagagaucuggcauuauggagguugaccggagcgaagcgaaagaggggcucaagagaggagagaccacaaaacacgccgucucccgcggcaccgcuaagcugcggugguuuguggaaagaaaucuugugaagccggaggggaaagucaucgaucugggauguggccgcgggggauggucuuacuauugcgccggccucaagaaaguuacggaagugaagggcuacacaaaagggggacccggccacgaggaaccuauucccauggcuaccuacggguggaaccuggugaagcugcauagcggaaaagacgucuucuuuaucccucccgagaagugugauacccuccuuugcgacauuggcgaguccagcccuaauccgacaaucgaagaggggcggacccugagagugcugaagaugguugaacccuggcuccgcggaaaccaauucuguauuaaaauccugaauccuuauaugcccucuguggucgagacacuugagcagaugcagcggaagcacggcggcaugcuggugagaaacccucucucccgcaauagcacgcaugaaauguacuggguuucuugcgggaccggaaacaucguguccgccgucaauaugacaagccggaugcugcugaacagauuuaccauggcgcaccgcaaacccacauaugagcgggauguggaccucggcgccgggaccagacacguggcugucgaaccggagguugccaaccuggauauuaucggacagcgcauugaaaauaucaagcaugagcacaaaucuacguggcauuacgacgaggauaacccuuauaagaccugggcuuaccacggcuccuaugaagugaagcccagcggguccgccagcucuauggugaauggagucgugaaacuucugacaaagcccugggacguuauuccuauggugacccaaaucgcuaugacagauaccacacccuucggccagcagagagucuuuaaagagaagguggacacccggacgccuaaagccaagcgcggcacagcgcaaaucauggaaguuaccgccaaguggcucuggggguuccugagcagaaacaaaaagccgcggauuuguaccagagaggaauuuacacggaaagugcgcuccaaugcugccaucggagcugucuucguggacgagaaccaguggaacucugccaaggaggccguugaagaugagagauuuugggaccuugugcaucgggaacgcgagcugcacaaacagggcaagugcgcgacgugcgucuacaacaugauggggaagagagagaaaaagcucggagaguucggcaaagcuaaggggagccgggccauuugguacauguggcugggcgcccgcuuccuggaguuugaagcucucggauucaugaaugaggaucacugguuuuccagagaaaacucucugagcggcguggagggggagggacuucauaaacugggcuauauccuccgggacauuuccaagauccccgggggaaauauguacgccgaugacaccgcuggcugggauacacgcaucaccgaagacgaucugcagaacgaggccaaaauuacagacaucauggaaccugagcacgcgcuucuggccaagucuauuuucaagcucaccuaucaaaauaaagucgugagaguucagcggcccgcuaagaacgggacagugauggaugucaucagccgcagagaccagcggggcuccggacaggugggcaccuacgggcugaauacguuuaccaacauggaagcccaacugauucgccagauggagagcgagggaaucuucucuccuuccgaacucgagacacccaaccuggcugaaagagugcuugauuggcuggagaaacauggcguugaacggcucaagagaauggccaucagcggggacgacuguguggucaaaccgauugaugaccgcuuugcgaccgcccugacagcucuuaaugauaugggaaaggugcggaaggacaucccucagugggagcccucuaaaggcuggaacgauuggcagcaaguuccuuucugcucccaccacuuucaucagcugauuaugaaggacgggagagagaucgugguccccugucgcaaucaggaugaacucgugggccgggccagagucagccagggagcuggcuggucccugcgcgagaccgccugccuggggaaaucuuaugcucaaauguggcagcucauguacuuccaccggagagaccugcgccuugccgcgaacgccauuuguagcgcugugccuguugauugggugcccacgucccggacaaccuggagcauccaugcccaccaucaguggaugacaaccgaagacaugcugucugucuggaauagaguguggauugaggaaaacccguggauggaggauaagacgcacaucuccagcuggggagacguuccuuaucucggcaaacgcgaggaccaauggugcgggucucugaucggacuuaccgcccgggcuacaugggccaccaauauucagguggcgaucaaccaggucagacggcugauuggcaaugaaaacuaccucgauuacaugacaagcaugaagagauuuaagaaugaguccgaccccgaaggggcucugugguga

SEQ ID NO: 18551 - RNA, 9879 nt, Artificial Sequence
  derived and/or modified CDS sequence (opt5) from DENV-1__FJ639676__SS-prME
agcgugaccaugcugcucaugcugaugcccacggcccuugcuuuccaccugacgaccagaggaggggaaccucauaugaucguguccaagcaggaacggggaaaaucucuccuguuuaagaccagcgccggcguuaacaugugcacccuuauugcgauggaccugggggaacucugugaagauacaaugaccuacaaaugcccgcgcaucacagagguggaacccgacgauguggacuguuggugcaauaccacggauaccugggucacauauggaaccuguucccaaacaggcgagcacagacgggacaagcgcucuguggcucuggccccucaugccgggcugggacucgagaccagagcugaaacguggaugagcuccgagggcgccuggaaacagauucagcggguugaaacaugggcucugcgccaccccggcuucaccgugaucgcccuuuuucuggcgcaugucauugggacaucuaucacccagaagggaaucauuuucauccuccugaugcuugugaccccuagcauggccaugagaugcguuggcauugggucccgggauuuuguggagggacugagcggcgcuacaugggucgacguggugcucgagcacgggucuugugucacgaccauggccaaggauaaacccacacuggacaucgaacugcucaagaccgagguuacaaacccugcugugcugcgcaaacuuugcauugaagccaagaucuccaauaccacgacagauagcagauguccgacccaaggagaggcgacccugguggaagaacaagacgccaacuucgucugccggcgcacauuuguggauagaggcuggggcaauggguguggacucuucggcaaagggucucugauuaccugcgcuaaguuuaagugcguuacaaaacuugagggaaagaucgugcaguacgaaaaccugaaauauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguagcccccggacaggccucgacuucaacgaaaugguccugcuuaccaugaaggagaaaagcuggcuggugcauaagcagugguuucucgaucugccucuucccuggacguccggggccucuacaagccaagagaccuggaaucgccaggaccugcucgucacauucaaaaccgcucacgcgaagaagcaggaagugguugugcugggaucccaagagggcgccaugcacaccgcucugacaggggccacggaaauucagaccagcggaacaaccacaaucuuugccggccaucucaaaugcagacugaagauggauaaacuuacccugaaggggaugucuuaugucauguguacgggcuccuucaaacucgagaaggaaguggcugagacacagcacggaaccguucuggugcagauuaaguacgagggcaccgacgccccgugcaaaaucccuuucagcacacaagaugaaaagggggucacccagaacggacggcugaucacagcgaaucccauugugacggacaaagagaagccugugaacaucgaagcugagccgcccuuuggcgagucuuauauuguuaucggggccggagaaaaagcccuuaagcucagcugguucaagaaaggcuccucuauugggaagauguuugaggcuaccgccagaggcgcucgccggauggccauccugggagauacagcgugggacuucggcagcaucgggggagucuuuaccuccgugggcaaacuggugcaucagauuuucgggacagccuacggaguccucuuuagcggcgugucuuggaccaugaagaucgggauuggcguucugcuuacguggcugggacucaauuccagaagcaccucucuguccaugacauguaucgcugugggccuggucacccuuuaccucggggugaugguucaggccgauagcggaugcgugauuaacuggaaaggccgcgaacugaaguguggguccggaaucuucgucacaaaugaggugcacaccuggacagaacaauauaaguuucaggcugacucuccuaaacggcugagcgccgcgauuggcaaggccugggaggaggggguuugcggcaucagauccgcuacccgccucgaaaacaucauguggcggcagauuucuaacgagcugaaucauauccuucuggaaaacgacaugaaauucacgguggucgugggagauguggucggcauucucgcccaggggaagaaaaugaucagaccgcaacccauggagcacaaguacagcuggaaauccuggggaaaggcuaagauuaucggcgccgacguucagaauacaaccuuuaucauugaugggccuaacacccccgaauguccugacgaucagcgcgccuggaauaucugggagguggaggacuauggauucggcauuuuuacaaccaacaucuggcugaaacugcgggauagcuacacacaggugugcgaccacagacuuaugucugcugcgauuaaggauuccaaagccguccaugcugacaugggcuauuggaucgaaagcgagaagaaugaaacauggaaacucgcccgcgccucuuucaucgaggugaagaccuguauuuggcccaagucccacacacuguggagcaacgggguucuggaaucugagaugaucauuccgaaaaucuacggaggcccuauuagccaacauaauuaucggcccggguacuucacccagacagcuggaccuuggcaccucggcaagcuggagcuugauuuugaccugugcgaagggaccacgguggucguggaugagcacugcggaaacagaggccccucccuccggaccacaaccguuacaggcaaaaucauccaugaaugguguugccgcagcuguacccugccuccccugagauucaagggggaggacggaugcugguacggcauggagauucggccggugaaagaaaaggaggaaaaucuugucaagucuaugguguccgccgggagcggagagguugacuccuuuucucucggccugcuguguaucagcauuaugaucgaagaggugaugagaucccgcuggucucggaaaaugcucaugacggggacacuggcggucuucuuucuucugauugugggacagcucaccuggaacgaucugaucagacugugcauuauggugggcgcuaaugccagcgaccgcaugggcauggggacaaccuaucuugcccugauggcuaccuucaagaugagaccuauguuugccgucggacuccuguuccggcgccucacauccagagagguucugcuucugacgaucggccucucucugguggcgagcguggaacugcccaacucccuugaggaacugggggauggacucgcuaugggcaucaugauucugaaacuccugaccgacuuucaaagcuaccagcuuugggccacacugcucucucugaccuucaucaagacaaccuuuucccugcacuaugccuggaaaacgauggcuaugguccuuagcauugugucucugcucccccugugucucuccacaaccagccagaagaccacauggcugccuguucuucuggggucucugggaugcaagccgcucaccauguucuuuaucgccgagaauaaaauuuggggccggaaguccuggccccugaacgaaggcaucauggcuguggggaucgucagcauucuucuguccagccuccugaaaaacgaugugccucucgccggaccccugaucgcgggcgggaugcuuauugccuguuacguuaucucuggaagcuccgcugaccugucucuggagaaggccgcugaggugagcugggaagaggaagccgagcauuccggcgccucucacaauauucucgucgaagugcaggaugacgggacaaugaaaaucaaggaugaggagcgcgacgauacgcugaccauccuucugaaagcuacacuccuggcggucagcggaguguauccucucuccauucccgccacccuguucguuugguacuucuggcaaaagaagaaacagagaucuggcgugcuuugggacacaccuuccccucccgaagucgagcgggcugugcuggaugacggcaucuaucgcauuaugcagagagggcugcucggacggucccagguuggcgugggggucuuucaagaaaacguguuccauaccauguggcacgugacgcgcggagccguucugauguaccagggcaagagacuugagcccagcugggccucugucaaaaaggaccugaucuccuacgggggaggcuggcggcuccagggcagcuggaauaccggggaggaaguccaggugauugcugucgagcccggcaagaauccuaagaaugugcaaacagcccccggcaccuuuaagacaccggaaggggagguuggagcgaucgcucuggauuucaaaccuggcaccucugggucccccauugugaacagagaaggaaagaucgucggccucuauggcaauggggugguuacaacgagcggaaccuacguguccgccaucgcccaggcuaaagccucucaggagggcccucugcccgagauugaagacgaggucuuucgcaagcggaaccuuacaaucauggaucugcaccccgggagcggaaaaaccagacgcuaucugccugcgauugugcgggaagcuaucaagagaaagcuccgcacccugauucuugccccgacacggguuguggccuccgagauggcugaagcccugaaaggcaugcccaucagauaccaaacgaccgcugucaagagcgagcauacagggcgcgagaucguggaccucaugugccacgccaccuucacaaugcggcugcugucuccugugagaguccccaauuauaacaugauuaucauggaugaagcgcauuuuaccgacccuuccagcauugccgcucggggcuacaucucuacgcgcguuggaaugggcgaggccgcugccauuuucaugacagccacacccccugggagcguggaggcuuuuccgcaguccaaugcggugauccaggaugaggaaagagacauccccgagcggucuuggaacagcggauaugaguggauuaccgauuucccuggcaaaacagucugguuugugcccuccaucaagucugggaaugacauugccaacugucuccgcaaaaauggaaagagaguuauccagcuuagccggaagaccuucgauacagaauaccagaaaaccaagaacaacgacugggacuacguggucacgacagauauuuccgagaugggcgcuaauuucagagccgaccgcgugaucgauccucggagaugccugaaacccguuauucugaaggacgggccggaacgcgugauccucgccggcccuaugcccgucaccguggcuagcgccgcgcagcggagaggacgcaucggccggaaccacaauaaagagggggaucaguauauuuacaugggacagccccugaacaaugacgaggaucaugcucacuggacagaagccaagaugcuucuggacaacaucaauaccccugagggcauuauccccgcccucuuugaaccugagagagaaaagucugcugccauugauggggaguaucgccugagaggagaggcgcggaaaacguucgucgaacugaugcgcagaggcgaccucccgguguggcuuuccuacaagguugccagcgagggguuucaauauuccgaucggcgcuggugcuucgacggcgaaagaaacaaucaggugcuggaggaaaacauggauguggagaucuggaccaaagagggagaacggaagaaacugagaccccgcuggcucgacgcucggacauacucugacccucuggcccuuagagaguuuaaggaguucgcugccggccgccggagcaucuccggggaucugauucucgagaucggaaaacugccccagcaccugacccagagagcucaaaaugcccucgacaaccuugucaugcugcauaauucugaacagggcgggcgggcguaucgccacgccauggaggagcugccugauacaauugaaacccucaugcugcuugcucugaucgccguucucacaggaggcgugacccuguuuuuccugagcggcagagggcucggaaagacguccauuggccuucugugugugauggcuagcucugcccugcucuggauggccuccgucgagccccauuggaucgcugcgagcaucauucuggaauuuuuccuuauggugcugcucaucccggagccugaccggcagcgcacaccccaggauaaccaacuggccuacguugugauugggcugcucuuuaugauccuuaccgucgcugccaaugagaugggacugcuggaaaccacaaagaaagaccucggcauugggcacguggccgucgagaaccaccaucacgcuaccaugcuggauguggaccuucauccugccucugcguggacacuguacgccguugcuacgaccaucauuacacccaugaugagacacaccaucgaaaacacaaccgccaauaucucccucacggcuauugccaaccaggcggccauccugaugggacuggauaagggcuggccuauuagcaaaauggacaucggcgugccccuccuugcucuggggugcuauucucaggucaauccgcugacccucacagccgcugugcugaugcuuguugcccauuacgcuauuaucggaccuggccugcaagccaaggcgacccgggaggcccagaaacgcacagcugccgggaucaugaagaaccccaccguggauggaauugucgcuaucgaccucgaucccgugguguaugacgccaaguucgaaaaacagcugggccagauuaugcugcucauccuuuguacgagccaaauucugcugaugagaacaaccugggcccucugcgaguccaucacacuggcgaccgggccucuuaccacacugugggagggaucuccgggcaaguuuuggaauacgaccaucgcuguuagcauggccaacauuuuccggggcuccuaccucgcuggggccggacuggccuucagccugaugaaaucccucggcgggggacgcagaggcacaggggcucagggagaaacccuuggcgagaaguggaaacggcagcugaaucagcugucuaagagcgaauuuaacacauauaagagauccggcauccucgaggucgaccgcucugaagccaaagaggggcugcggagaggagagaccacgaagcacgcggugagccgcggcacagccaaacuucggugguucguggaaagaaaucuggucaagcccgaggggaaaguuauugaucucggauguggccgcgggggaugguccuacuauugcgcuggccugaagaaggugaccgaagugaaaggcuacaccaaagggggaccuggccacgaggaacccaucccuauggccacauacggguggaaccuggucaaacuccauucuggaaaggacguguuuuucauucccccugagaaaugugauacccuucugugcgacaucggcgagagcuccccgaaucccacaauugaagaggggcggacgcugagaguucucaagaugguggaaccuuggcugcgcggaaaccaauuuuguaucaaaauccuuaaucccuauaugccuagcgucguggagacccuggagcagaugcagcggaagcacggcggcaugcucguuagaaacccccugucucgcaauuccacacaugaaauguacugggugagcugcgggaccggaaacauugucucugcugugaauaugacaucccggaugcugcucaacagauucaccauggcccaccgcaagccgacguaugagagagauguggaccugggcgcggggacccggcacgucgccguugaaccugagguggcuaaccuugauaucauuggacagcgcaucgaaaauauuaaacaugagcacaagagcacauggcauuacgacgaggauaaccccuauaaaaccugggccuaccacggcucuuaugaagugaagcccuccgggagcgcuuccagcauggucaauggagugguuaaacugcucacaaagccuugggacgugauccccauggucacccaaaucgccaugacagauaccacgccuuuuggccagcagagaguguucaaggagaaaguugacacacggaccccgaaggcuaaaagaggcaccgcccaaauuauggaagugacagcgcgguggcuguggggguuucuuucucgcaacaagaaacccagaaucuguacgcgggaggaguucacccgcaaggucagaagcaaugccgcuauuggagccguguuuguugacgagaaccaguggaacuccgcuaaggaggccguggaagaugagcgguucugggaccugguccaucgcgaaagagagcuccacaaacagggcaagugcgccacaugcguguacaacaugauggggaaacgggaaaagaaacugggagaguuuggcaaggcgaaggggucucgcgcuaucugguacauguggcugggcgccagauuccucgaguucgaagcccugggauuuaugaaugaggaucacugguucagccgggaaaacucccuuucuggcgucgagggggagggacugcauaaacucggcuauauucugcgcgacaucagcaagaucccugggggaaauauguacgcugaugacaccgccggcugggauacaagaauuaccgaagacgaucuucagaacgaggcuaaaaucacagacauuauggaacccgagcacgcccugcucgcgaccuccaucuuuaagcugacguaucaaaauaaagugguucgggugcagcgcccugccaagaacgggaccgucauggaugugauuucuagacgggaccagagaggcagcggacaggugggcacauacgggcugaauaccuucacaaacauggaagcucaacucauccgccagauggaguccgagggaaucuuuagccccucugaacuggagaccccgaaccuugccgaacggguucuggauuggcucgagaaauauggcguggaaagacugaagcgcauggcuauuuccggggacgacugugucgugaagccuaucgaugaccgguucgccacggcgcuuacagcccugaaugauaugggaaaaguuagaaaggacauuccccagugggagccuagcaaaggcuggaacgauuggcagcaagugcccuuuugcucucaucacuuccaccagcucaucaugaaggacgggcgcgagauugucgugccuugucggaaucaggaugaacuggucggcagagcucgcgugucccagggagccggcuggagccugcgggagaccgcuugccucgggaaauccuacgcccaaauguggcagcugauguauuuucauagacgcgaccuucggcuggcugccaacgcgaucuguucugccguucccguggauugggucccgacaagcagaaccacgugguccauucacgcucaucaccaguggaugaccacagaagacaugcucagcguguggaaucggguuuggaucgaggaaaacccuuggauggaggauaagacccauaucucuuccugggaggacgugcccuaccugggaaagagagaagaccaauggugcggcagccuuauugggcugacagcccgcgccaccugggcuacaaauauccaggucgccauuaaccaggugcggagacucaucggaaaugagaacuaccuggauuucaugaccucuaugaaacgcuuuaagaaugaaagcgacacggagggcgcgcugugguga

SEQ ID NO: 18552 - RNA, 9879 nt, Artificial Sequence
  derived and/or modified CDS sequence (opt5) from DENV-1__FJ639677__SS-prME
agcgugaccaugcugcucaugcugaugcccaccgcccuugcuuuccaccugacgacccggggcggggaaccucauaugaucguguccaagcaggaacggggaaagucucuccuguuuaagaccagcgccggcguuaacaugugcacccuuaucgcgauggaccugggggaacucugugaagauacaaugaccuacaagugcccccgcgugacagaggcugaacccgacgauguggacuguuggugcaaugccaccgauacguggguuaccuauggaacauguucccaaaccggcgagcaccggcgggacaagcgcucuguggcccuggcuccucauguugggcugggacucgagacaagaaccgaaacguggaugagcuccgagggcgccuggaaacagauccagcggguggaaacaugggcucugcgccaccccggcuucaccgucauugcccuuuuucuggcgcaugccaucgggacaucuauuacccagaagggaaucaucuucauucuccugaugcuugugaccccuagcauggcuaugagaugcguuggcaucgggucccgggauuuuguggagggacugagcggcgccacaugggucgacguggugcucgagcacgggucuugugucacgaccauggcuaaggauaaacccacacuggacauugaacugcucaagaccgagguuacaaacccugccgugcugcgcaaacuuugcaucgaagcgaagauuuccaauaccacgacagauagcagauguccgacccaaggagaggccacccugguggaagaacaggacgcuaacuucgucugccggcgcacauuuguggauagaggcuggggcaauggguguggacucuucggcaaagggucucugauuaccugcgccaaguuuaagugcguuacaaaacuugagggaaagauugugcaguacgaaaaccugaaauauuccgucaucgugacgguucacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguccugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaagugguugugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuaugucauguguacaggcucuuucaaacucgagaaggaaguggccgagacccagcacggaaccguucuggugcagaucaaguacgagggcacagacgcgccgugcaaaauuccuuucuccacccaagaugaaaagggggucacacagaacggacggcugaucacggcuaaucccaucgugaccgacaaagagaagccugugaacauugaagccgagccgcccuuuggcgagagcuauaucguuauuggggccggagaaaaagcucuuaagcucucuugguucaagaaaggcagcuccaucgggaagauguuugaggccacagcuagaggcgcccgccggauggcgauucugggagauaccgccugggacuucggcucuaucgggggagucuuuacaagcgugggcaaacuggugcaucagaucuucgggaccgcuuacggaguccucuuuuccggcgugagcuggacgaugaagauugggaucggcguucugcuuaccuggcugggacucaauucuagauccacaagccugucuaugaccuguauugccgugggccuggucacacuuuaccucggggugaugguucaggcugauuccggaugcgugaucaacuggaaaggccgcgaacugaagugugggagcggaauuuucgucaccaaugaggugcacacauggaccgaacaauauaaguuucaggccgacuccccuaaacggcugucugcggccaucggcaaggcuugggaggaggggguuugcggcauuagaagcgccacgcgccucgaaaacaucauguggaaacagaucuccaacgagcugaaucauauucuucuggaaaacgacaugaagcucacaguggucgugggagauguggcuggcauccuggcccaggggaaaaagaugauucggccgcaacccauggaguacaaauauucuuggaaaagcuggggaaaggccaagaucauuggcgcugacgcgcagaauaccaccuucaucaucgaugggccuaacacacccgaauguccugacgaucagagagccuggaauauuugggaggucgaggacuacggauuuggcaucuucaccacgaacauuuggcugaaacuucgcgauuccuauacacagguuugcgaccaccggcucaugagcgcugccaucaaagauucuaaggccgugcacgcugacaugggcuacuggauugaauccgagaaaaaugaaaccuggaagcuggccagagcgagcuuuaucgaggugaagacauguaucuggcccaaaucucauacccugugguccaacgggguccucgaaagcgagaugauuaucccgaagauuuauggaggcccuaucucucaacacaauuaccgccccggguacuucacacagaccgcuggaccuuggcaucugggcaaacuugagcuggauuucgaccucugcgaagggacgaccgugguuguggaugagcacugcggaaaccggggccccagccugagaacaaccacagucaccggcaagauuauccacgaaugguguugccgguccuguacgcugccuccccuucgcuuuagaggggaggacggaugcugguauggcauggagauccggccggugaaagaaaaggaggaaaaucucguuaagagcauggugucugccggguccggagaggucgacagcuucucccugggccugcucuguauuucuaucaugauugaagaggugaugagaagccgcuggucccggaaaaugcugaugacagggacccuugccgucuuuuuccugcucaucaugggacagcugacauggaacgaucugauuagacuuugcaucauggugggcgcuaaugccucugaccgcaugggcauggggaccaccuaccuggcgcucauggcuacauuuaagaugagaccuauguucgccaugggacugcucuuucggcgccugacgagcagagagguccuucugcucaccauuggccugucccugguggccucuguggaacuucccaacagccuggaggaacucggggauggacuggcuaugggcaucaugauccucaaacugcuuacagacuuccaaucccaucagcugugggccacccuccugagccugacauuuauuaagaccacguucucucuucacuaugcuuggaaaacaauggccaugguccuguccaucguuagccucuuuccccugugucucucuaccaccucccagaagacaaccuggcugccugugcuucuggggagccugggaugcaagccgcucacaauguuccugauugcggagaauaaaaucuggggccggaagucuuggccccuuaacgaaggcauuauggccguggggaucgucuccauccugcucagcucccugcucaaaaacgaugugccucuggcuggaccccuuauugccggcgggaugcugaucgcuuguuacguuauuagcggaucuagcgccgaccugucccucgagaaggccgcugaggugucuugggaagaggaagcggagcauagcggcgccucccacaauauccuggucgaagugcaggaugacgggacgaugaaaauuaaggaugaggagcgcgacgauacccuuacaauccugcucaaagcuacccugcucgccguuucuggaguguauccucugagcauccccgccacacuuuuugucugguacuucuggcaaaagaagaaacagagauccggcgugcugugggacaccccuucucccccggaagucgagcgggcugugcuggaugacggcauuuaucgcaucaugcagagagggcuccugggacggagccagguuggcgugggggucuuccaagaaaacguguuucauacgauguggcacguuacccgcggagccgugcuuauguaccagggcaagagacuggagccuuccugggcgagcgucaaaaaggaccucauuucuuacgggggaggcuggcggcugaaaggcuccuggaauacaggggaggaaguccaggugaucgcuguugagcccggaaagaacccuaagaauguccagaccgcccccggcacauucaaaaccccggaaggggaggugggagccauugcucucgauuuuaagccuggcacaagcgggucucccaucgugaacagagaaggaaaaauugucggccuguauggcaauggggugguuacgaccuccggaacauacgugagcgccaucgcgcaagcuaaggccucccaggagggcccucuucccgagaucgaagacgaggucuuccgcaaacggaaccugaccauuauggaucugcaccccgggucuggaaagaccagacgcuaucucccugccaucgugcgggaagcuauuaagagaaaacugcgcacacuuauccuggccccgacgcggguuguggcuagcgagauggccgaagcgcucaagggcaugcccauuagauaccagaccacagccgucaaauccgagcauaccgggaaggagaucguggaccugaugugccacgcuacauuuaccaugcgccugcucagcccuguucgggugcccaauuauaacaugaucauuauggaugaagcccauuucacggacccuucuuccaucgcugccagaggcuacauuagcacacgggucggaaugggcgaggccgcugcgaucuuuaugaccgccacacccccugggucuguggaggcuuucccgcaaagcaaugccgugauucaggaugaggaacgcgacauccccgagagauccuggaacucuggauaugaguggaucacagauuuuccuggcaaaaccgucugguucguucccagcauuaaguccgggaaugacaucgccaacugucuucggaagaauggaaaacgcgugauucagcugucuagaaagacauuugauaccgaauaccagaaaacgaagaacaacgacugggacuacguggucacaaccgauaucagcgagaugggcgcuaauuuccgggccgacagagugauugauccucgccggugccugaaacccguuauccucaaggacgggccggaaagagugauucuggcgggcccuaugcccgucacaguggcuuccgccgcccaacgccggggaagaaucggccgcaaccacaauaaggagggggaucaguauaucuacaugggacagccccuuaacaaugacgaggaucaugcucacuggaccgaagccaaaaugcugcucgacaacauuaauacgccugagggcaucauucccgcgcuguucgaaccugagcgggaaaagagcgccgcuaucgauggggaguauagacugcgcggagaggccagaaaaaccuuuguugaacucaugcggcgcggcgaccuuccgguguggcugucuuacaaggucgcuuccgagggguuccaguauagcgauagacgguggugcuuugacggcgaacgcaacaaucaagugcuggaggaaaacauggaugucgagauuuggacaaaagagggagaaagaaagaaacuccggcccagauggcuggacgcccgcaccuacuccgacccucuugcucugcgggaguucaaggaauuugccgcgggcagacgcucugugagcggggaucucauccuggagaucggaaagcugccccagcaccucacacagcgggcccagaaugcucuugacaaccugguuaugcugcauaauuccgaacaaggcgggagagccuaucggcacgcuauggaggagcucccugauaccauugaaacacugaugcuucuggcccucaucgccgugcugaccggaggcgugacgcuguucuuucucucuggccgcgggcuuggaaaaacaagcauuggccugcugugugucauggcuuccagcguucuccuguggauggcgucuguggagccccauuggaucgccgcuuccauuauccuugaguucuuucugauggugcuccugaucccggagccugacagacagcggacaccccaggauaaccagcuggccuacgucgugauugggcuccuuuucaugauccugaccguugccgcuaaugagaugggacugcucgaaacaaccaagaaagaccugggcauugggcacguggccgucgagaaccaccaucacgcggccaugcuugauguggaccugcauccugcuagcgccuggacacucuacgcugucgccacgaccaucauuacacccaugaugcgccacaccaucgaaaacacaaccgcgaauauuucucugacggccaucgcuaaccaagccgcuauccugaugggacucgauaagggcuggccuauuuccaaaauggacaucggcgugccccuucuggcccuggggugcuauagccagguuaauccgcucacccugacagcugccgugcuuaugcuggucgcgcauuacgccauuaucggaccuggccuccaggcuaaggccaccagagaggcucaaaagcggacagccgccgggauuaugaaaaaccccaccguggauggaaucguugcgaucgaccuggaucccguggucuaugacgcuaaguuugaaaaacagcugggccagauuaugcuccuuauccuguguacgucucagauucugcucaugcgcacaaccugggcccugugcgagagcaucacacuugcuaccgggccucugaccacacucugggagggauccccgggcaaguucuggaauacgaccauugccgugucuauggccaacaucuuuagaggcagcuaccuggcuggggccggacuggcguucucccucaugaaaagccuuggcgggggacggcgcggcacaggggcccaaggagaaacccugggcgagaaguggaagagacagcugaaucagcucuccaaaucugaguucaacacauauaagcggagcggcaucauggagguggacagauccgaagcuaaagaggggcugaagcgcggagagaccacgaaacacgccguuucucggggcacagcuaaacuuagaugguuugucgaacgcaaucuggugaagcccgaggggaaagugauugaucucggauguggcagaggcggguggagcuacuauugcgccgggcugaagaaagucaccgaaguuaagggcuacaccaaagggggaccuggccacgaggaacccaucccuauggcgacauacggguggaaccuggugaagcuccauuccggaaaagacguguucuuuauucccccugagaagugugauacccuucugugcgacaucggcgagucuagcccgaaucccacaauugaagaggggagaacgcugcgcguccucaagaugguggaaccuuggcugcggggaaaccaguucuguaucaaaauucuuaaucccuauaugccuuccguuguggagacccuggagcaaaugcagagaaagcacggcggcaugcucguccgcaacccccugagcagaaauucuacacaugaaauguacuggguguccugcgggaccggaaacaucguuagcgccgugaauaugacaucuagaaugcugcucaaccgcuuuaccauggcucaccggaaaccgacguaugagagagaugucgaccugggcaccgggacacgccacguggccguggaaccugaggucgcuaaccuugauaucauuggacagagaaucgaaaauauuaagcaugagcacaaauccaccuggcauuacgacgaggauaaccccuauaagacaugggccuaccacggcagcuaugaaguuaagcccucuggguccgcuagcuccauggugaauggaguggucaaacugcucaccaagccuugggacgugauccccaugguuacacagauugccaugaccgauacgacaccuuucggccaacagcggguguuuaaagagaaggucgacacccgcaccccgaaagcgaagagaggcacagcccagaucauggaagugacggcucgguggcuguggggguuccuuagcagaucuaagaaaccccggaucuguacccgcgaggaauuuauuagaaagguucggagcaacgccgcuaucggagccguguucgucgacgagaaucaauggaacuccgccaaagaggcgguggaagaugagcgcuuuugggaccugguucauagagaacgggagcuccacaagcagggcaaaugcgcuacaugcguguacaauaugauggggaagcgcgaaaagaaacugggagaguucggcaaggccaaagggucuagagccauuugguacauguggcugggcgcucgguuucucgaguucgaagcccugggauucaugaacgaggaucacugguuuagccgcgaaaauucccuuucuggcgucgagggggagggacugcauaagcucggcuauauccugagagacauuagcaaaaucccugggggaaacauguacgcugaugacaccgccggcugggauacacggaucaccgaagacgaucuucagaaugaggcgaagauuacagacaucauggaacccgagcacgcccugcucgcuaaagccauuuucaagcugaccuaucagaacaaggugguccgcgugcaaagaccugcuaaaaaugggacgguuauggaugugaucucccggcgcgaccagagaggcucuggacaggucggcaccuacgggcugaacacauuuaccaauauggaagcccagcucauucggcaaauggagagcgagggaaucuucucccccagcgaacuggagacaccgaaccuugcggaaagagcccuggauuggcucgagaaguauggcguggaacgccugaaacggauggcuaucucuggggacgacugugugguuaagccuauugaugacagauuugccaccgcucuuacggcccugaacgauaugggaaaagugcgcaaggacaucccccagugggagccuuccaagggcuggaaugauuggcagcagguccccuucugcagccaucacuuucaccaacucauuaugaaagacgggcgggagaucgugguuccuuguagaaaccaggaugaacuggugggccgcgcucgggucucucagggagccggcuggucccugagagagacagcgugccucggaaagagcuacgcccagauguggcaacugauguauuuccaucgccgggaccuuagacuggcugccaaugccauuuguuccgcugugcccgucgauugggugccgaccucucgcacaaccuggagcauccacgcccaucaccaguggaugacgaccgaagacaugcucuccguuuggaaccggguguggauugaggaaaauccuuggauggaggauaaaacacauaucagcucuugggaggacguccccuaccugggaaagagagaagaccaguggugcggcucccuuaucgggcugaccgcgcgggcuacaugggccaccaacauucaaguggccaucaaucagguuagacgccucauuggaaacgagaauuaccuggauuauaugacaagcaugaaacgguuuaagaacgaaucugaccccgagggcgcucugugguga

SEQ ID NO: 18553 - RNA, 9879 nt, Artificial Sequence
  derived and/or modified CDS sequence (opt5) from DENV-1__GQ868618__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccgcccuucggcgagucuuauauugugaucggggccggagaaaaagcucugaaacuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaaguuuacgguuguggucggagauguggcuggcauucuggcccaggggaaaaagaugauccggccgcaacccauggaguacaaauauagcuggaaguccuggggaaaggccaaaauuaucggcgcugacgugcagaauacaaccuucaucauugaugggccuaacacccccgaauguccugacgaucagagagcguggaauaucugggaggucgaggacuacggauuuggcauuuucacaaccaacaucuggcucaagcugcgcgauagcuauacgcagguuugcgaccaccggcugaugucugccgcuauuaaagauuccaaggccgugcacgccgacaugggcuacuggaucgaaagcgagaaaaaugaaacauggaaacuugcuagagccucuuucaucgaggugaagaccuguauuuggcccaaaucccauacacucuggagcaacgggguccuggaaucugagaugaucauuccgaagaucuauggaggcccuauuagccaacacaauuaccgccccggguacuuuacccagacagcgggaccuuggcaucugggcaaacucgagcuggauuucgaccuuugcgaagggaccacggugguuguggaugagcacugcggaaaccggggccccucccugagaaccacaaccgucacaggcaagaucauccacgaaugguguugccggagcuguacccucccuccccugcgcuuuaaaggggaggacggaugcugguauggcauggagauuagaccggugaaggaaaaggaggaaaaucugguuaaaucuaugguguccgcugggagcggagaggucgacuccuucucucuuggccuccuguguaucagcauuaugaucgaagaggugaugcgguccagauggucucgcaagaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaaaaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaagcugcucaccgacuuccaaagccaucagcugugggcuacacuucugucucucaccuuuaucaaaacaaccuucucccugcacuaugccuggaagacgauggcuaugguucugagcauugugucucuuuuuccccugugucucuccacaaccagccagaagaccacauggcugccugugcuccuggggucucuuggaugcaaaccgcugaccauguuccugaucgccgagaauaagauuuggggcagaaaauccuggccccucaacgaaggcaucauggcggucgggaucgugagcauucugcuuuccagccugcucaagaacgauguuccucuggccggaccccucaucgcuggcgggaugcugauugccuguuacgugaucucuggaagcuccgcugaccuuucucuggagaaagccgccgaggucagcugggaagaggaagcugagcauuccggcgcgucucacaauauucugguggaaguucaggaugacgggacaaugaagaucaaagaugaggagcgggacgauacgcucaccauccugcuuaaggccacacugcucgcugugagcggagucuauccucuguccauucccgccacccucuucgugugguacuuuuggcaaaagaaaaagcagcgcucuggcguccugugggacacaccuuccccucccgaaguggagagagccguucuugaugacggcaucuaucggauuaugcagcgcgggcugcugggaagaucccaggugggcgucgggguguuccaagaaaacguuuuucauaccauguggcacgugacgcggggagcuguccucauguaccagggcaaacgccuggagcccagcugggccucugugaagaaagaccuuaucuccuacgggggaggcuggagacugcagggcagcuggaauaccggggaggaagugcagguuauugcggucgagcccggaaagaacccuaagaaugugcaaacagcucccggcaccuucaaaacaucugaaggggaggugggagccaucgcccucgauuuuaagccgggcaccuccgggagcccuauugucaaccgggaaggaaaaaucgugggccuguauggcaaugggguugugacaacguccggaaccuacgucucugcuaucgcccaggcgaaggcuagccaggagggcccccucccugagauugaagacgagguguucagaaaacgcaaccugacaaucauggaucuucaccccggguccggaaagacccggagauaucugcccgccauuguucgcgaagccaucaagcggaaacugagaacccucauucuggcuccuacacgcguggucgccagcgagauggcugaagcccuuaagggcaugccgauccgguaccaaacgaccgcggugaaaucugagcauacagggaaggagaucguugaccugaugugccacgccaccuuuacaaugagacuccugucccccgugcgcgucccuaauuauaacaugauuaucauggaugaagcucauuucaccgaccccagcucuauugccgcucggggcuacaucagcacgagagugggaaugggcgaggccgccgcuauuuuuaugacagcgaccccucccggguccguggaagccuucccucagucuaaugcugucauccaggaugaggaacgggacaucccggagcgcagcuggaacuccggauaugaguggauuaccgauuuucccggcaaaacaguuugguucgugccuucuaucaagagcgggaaugacauugccaacugucugagaaagaauggaaaacgggugauccagcucucccgcaagaccuucgauacagaauaccagaagaccaagaacaacgacugggacuacgucgugacgacagauauuagcgagaugggcgccaauuuuagagcugaccggguuaucgaucccagacgcugccuuaaaccugugauucugaaggacgggcccgaacgggucauccuggccggcccgaugccugugaccguugcgucugcugcccagagacgcggacggaucggcagaaaccacaauaaggagggggaucaguauauuuacaugggacagccccucaacaaugacgaggaucaugcccacuggacagaagcuaaaaugcugcuugacaacaucaauacccccgagggcauuaucccugcccuguucgaacccgagcgcgaaaaguccgcggccauugauggggaguaucggcucagaggagaggcucgcaaaacguuuguggaacugaugagacggggcgaccugccugucuggcucagcuacaagguggccuccgagggguuccaauauucugaucgcagauggugcuuugacggcgaacggaacaaucagguccuugaggaaaacauggauguggagaucuggaccaaagagggagaacgcaagaaacugagaccgcgguggcuggacgcuagaacauacagcgacccccucgcccugcgcgaguucaaggaauuugcugccggccggagauccguuucuggggaucuuauccuggagauuggaaagcucccucagcaccugacccagcgcgcgcaaaaugcccuggacaaccucgugaugcuucauaauagcgaacagggcgggcgggcuuauagacacgccauggaggagcugcccgauacaaucgaaacccugaugcuccuggcucuuauugccgugcugacaggaggcgucacccucuucuuucuguccggccgggggcugggaaaaacgagcaucggccuccuuuguguuauggccucuuccgugcugcuguggauggcuagcguggagccucauuggauugcggccucuaucauccucgaguucuuucugaugguccuucugauucccgagccggaccgccagagaacaccucaggauaaccaacucgcuuacgugguuaucgggcugcuguucaugauucucaccguggccgccaaugagaugggacuucuggaaaccacaaagaaagaccugggcaucgggcacgucgcuguggagaaccaccaucacgccgcgaugcucgaugucgaccugcaucccgccuccgcuuggacccuuuacgccguggcuacaacgauuaucaccccuaugaugcggcacacaauugaaaacaccacagccaauaucagccugaccgcgaucgccaaccaggcugccauucucaugggacuggauaagggcuggcccaucucuaaaauggacauuggcguuccucugcucgcucuugggugcuauagccaggugaauccccugacgcugaccgccgcuguccucaugcugguggcccauuacgcgaucauuggaccgggccuucaagccaaggcuacacgcgaggcccagaagagaaccgcugccgggaucaugaaaaacccuacaguugauggaaucguggccauugaccuggaucccgucguguaugacgcgaaguuugaaaaacagcucggccagaucaugcugcugauucucuguaccucccaaauccuucugaugcggacgacaugggcucugugcgagucuauuacccucgccacagggccccugaccacccuuugggagggaagcccuggcaaguucuggaauacaacgaucgcuguguccauggccaacaucuuccgcggcagcuaccuggccggggcuggacucgccuuuucccugaugaaaucucugggcgggggaagacggggcaccggggcgcagggagaaacacucggcgagaaguggaagcgccagcuuaaucagcugagcaaauccgaguucaacaccuauaagagaucuggcauuauggagguugaccggagcgaagccaaagaggggcugaagagaggagagacaaccaaacacgcugucucccgcggcacggccaagcuccggugguuuguggaaagaaaucuggugaagccggaggggaaagucaucgaucuuggauguggccgcgggggauggucuuacuauugcgcuggccugaagaaaguuacagaagugaagggcuacaccaaagggggacccggccacgaggaaccuauucccauggccaccuacggguggaaccucgugaagcugcauagcggaaaagacgucuucuuuaucccucccgagaagugugauacacugcucugcgacauuggcgaguccagcccuaauccgaccaucgaagaggggcggacacuuagagugcugaagaugguugaacccuggcugcgcggaaaccaauucuguauuaaaauccucaauccuuauaugcccucuguggucgagacgcuggagcagaugcagcggaagcacggcggcaugcuugugagaaacccucugucccgcaauagcacccaugaaauguacuggguuucuugcgggacaggaaacaucguguccgcggucaauaugaccagccggaugcuccugaacagauuuacaauggcccaccgcaaacccaccuaugagcgggauguggaccugggcgcugggacgagacacguggccgucgaaccggagguugcuaaccucgauauuaucggacagcgcauugaaaauaucaagcaugagcacaaaucuaccuggcauuacgacgaggauaacccuuauaagacaugggccuaccacggcuccuaugaagugaagcccagcggguccgcuagcucuauggugaauggagucgugaaacugcuuaccaagcccugggacguuauuccuauggugacacaaaucgccaugaccgauacaacccccuucggccagcagagagucuuuaaagagaagguggacacgcggacaccuaaagcgaagcgcggcaccgcccaaaucauggaaguuaccgcuaaguggcuguggggguuccucagcagaaacaaaaagccgcggauuuguacaagagaggaauuuacgcggaaagugcgcuccaaugccgcuaucggagccgucuucguggacgagaaccaguggaacucugccaaggaggcgguugaagaugagagauuuugggaccuggugcaucgggaacgcgagcuucacaaacagggcaagugcgcuaccugcgucuacaacaugauggggaagagagagaagaagcugggagaguucggcaaagccaaggggagccgggccauuugguacauguggcucggcgcucgcuuccuggaguuugaagcccugggauucaugaaugaggaucacugguuuuccagagaaaacucucucagcggcguggagggggagggacugcauaaacuuggcuauauccugcgggacauuuccaagauccccgggggaaauauguacgcugaugacacagccggcugggauacccgcaucacagaagacgaucuccagaacgaggcgaaaauuaccgacaucauggaaccugagcacgcccugcuugcuaagucuauuuucaagcugacauaucaaaauaaagucgugagaguucagcggcccgccaagaacgggaccgugauggaugucaucagccgcagagaccagcggggcuccggacaggugggcacguacgggcucaauaccuuuacaaacauggaagcucaacugauucgccagauggagagcgagggaaucuucucuccuuccgaacuggagacccccaaccucgccgaaagagugcuggauuggcuugagaaacauggcguugaacggcugaagagaauggcgaucagcggggacgacuguguggucaaaccgauugaugaccgcuuugccacagcucucaccgcccugaaugauaugggaaaggugcggaaggacaucccucagugggagcccucuaaaggcuggaacgauuggcagcaaguuccuuucugcucccaccacuuucaucagcuuauuaugaaggacgggagagagaucgugguccccugucgcaaucaggaugaacuggugggccgggcuagagucagccagggagccggcuggucccuccgcgagacggcuugccuggggaaaucuuaugcccaaauguggcagcugauguacuuccaccggagagaccuccgccuggcggccaacgcuauuuguagcgccgugccuguugauugggugcccacaucccggaccacauggagcauccaugcccaccaucaguggaugaccacggaagacaugcuuucugucuggaauagaguguggauugaggaaaacccguggauggaggauaagacccacaucuccagcuggggagacguuccuuaucugggcaaacgcgaggaccaauggugcgggucucucaucggacugacagcucgggccaccugggcgacaaauauucagguggcuaucaaccaggucagacggcuuauuggcaaugaaaacuaccuggauuacaugaccagcaugaagagauuuaagaaugaguccgaccccgaaggggcccucugguga

SEQ ID NO: 18554 - RNA, 9879 nt, Artificial Sequence
  derived and/or modified CDS sequence (opt5) from DENV-1__GQ868619__SS-prME
agcgugaccaugcugcucaugcugaugcccaccgcccuugcuuuccaccugacgacccggggaggggaaccucauaugaucgucuccaagcaggaacggggaaaaucucuccuguuuaagacaagcgccggcguuaacaugugcacccuuauugcgauggaccugggggaacucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggcccaggggaaaaagaugauccggccgcaacccauggaguacaaauauucuuggaaaagcuggggaaaggccaagauuaucggcgcugacgcgcagaauaccaccuucaucauugaugggccuaacacacccgaauguccugacgaucagagagccuggaauaucugggagguggaggacuacggauuuggcauuuucaccacgaacaucuggcugaaacuucgcgauuccuauacacaggucugcgaccaccggcucaugagcgcugccauuaaagauucuaaggccguucacgcugacaugggcuacuggaucgaauccgagaaaaaugaaaccuggaagcuggccagagcgagcuuuaucgaggugaagacauguauuuggcccaaaucucauacccugugguccaacggggugcucgaaagcgagaugaucauuccgaagaucuauggaggcccuauuucucaacacaauuaccgccccggguacuucacacagaccgcuggaccuuggcaucugggcaaacuugagcuggauuucgaccucugcgaagggacgaccgucgugguugaugagcacugcggaaaccggggccccagccugagaacaaccacagugaccggcaagaucauccacgaaugguguugccgguccuguacgcugccuccccuucgcuuuagaggggaggacggaugcugguauggcauggagauucggccggucaaagaaaaggaggaaaaucucgugaaaagcaugguuucugccggguccggagagguggacagcuucucccugggccugcucuguaucucuauuaugaucgaagaggucaugagaagccgcuggucccggaaaaugcugaugacagggacccuuguggucuuuuuccugcucauuaugggacagcugacauggaacgaucugaucagacuuugcauuauggugggcgccaaugcuucugaccgcaugggcauggggaccaccuaccuggcccucauggcgacauuuaagaugagaccuauguucgcugucggacugcucuuucggcgccugacgagcagagaggugcuucugcucaccaucggccugucccugguggccucugucgaacuucccaacagccuggaggaacucggggauggacuggccaugggcaucaugauucucaaacugcuuacagacuuccaaucccaucagcugugggcuacccuccugagccugacauuuaucaagaccacguucucucuucacuaugccuggaaaacaauggcuaugguucuguccauugugagccucuuuccccugugucucucuaccaccucccagaagacaaccuggcugccugugcuucuggggagccugggaugcaagccgcucacaauguuccugaucgccgagaauaaaauuuggggccggaagucuuggccccuuaacgaaggcaucauggcggucgggaucguguccauucugcucagcucccugcucaaaaacgauguuccucuggccggaccccuuaucgcuggcgggaugcugauugccuguuacgugaucagcggaucuagcgcugaccugucccucgagaaggccgccgaggucucuugggaagaggaagcugagcauagcggcgcgucccacaauauucugguggaaguucaggaugacgggacgaugaaaaucaaggaugaggagcgcgacgauacccuuacaauccugcucaaagccacccugcucgcugugucuggagucuauccucugagcauucccgccacacuuuuugugugguacuucuggcaaaagaagaaacagagauccggcguccugugggacaccccuucucccccggaaguggagcgggccguucuggaugacggcaucuaucgcauuaugcagagagggcuccugggacggagccaggugggcgucgggguguuccaagaaaacguuuuucauacgauguggcacgugacccgcggagcuguccuuauguaccagggcaagagacuggagccuuccugggccagcgugaaaaaggaccucaucucuuacgggggaggcuggcggcugcagggcuccuggaauacaggggaggaagugcagguuauugcggucgagcccggcaagaacccuaagaaugugcaaaccgcucccggcacauucaagaccccggaaggggaggugggagccaucgcccucgauuuuaaaccuggcacaagcgggucucccauugucaacagagaaggaaagaucgugggccuguauggcaaugggguugugacgaccuccggaacauacgucagcgcuaucgcccaggcgaaggcuucccaggagggcccucuucccgagauugaagacgagguguuccgcaagcggaaccugaccaucauggaucugcaccccgggucuggaaaaaccagacgcuaucucccugccauuguucgggaagccaucaagagaaagcugcgcacacuuauucuggcuccgacgcggguggucgccagcgagauggcugaagcccucaaaggcaugcccaucagauaccaaaccacagcggugaaguccgagcauaccgggaaagagaucguugaccugaugugccacgccacauuuaccaugcgccugcucagcccugugcggguccccaauuauaacaugauuaucauggaugaagcucauuucacggacccuucuuccauugccgcuagaggcuacaucagcacacgggugggaaugggcgaggccgccgcuauuuuuaugaccgcgacacccccugggucuauggaagccuucccgcagagcaaugcugugauccaggaugaggaacgcgacauccccgagagauccuggaacucuggauaugaguggauuacagauuuuccuggcaagaccgucugguucguucccagcaucaaauccgggaaugacauugccaacugucuucggaagaauggaaagcgcgugauccagcugucuagaaaaacauuugauaccgaauaccaaaagacgaaaaacaacgacugggacuacguggucacaaccgauauuagcgagaugggcgccaauuuccgggcugacagagugaucgauccucgccggugccugaagcccauuauccucaaagacgggccggaaagaguuauccuggccggcccuaugcccgugacagucgcguccgcugcccagcgccggggaagaauuggccgcaaccacaauaaggagggggaucaguauaucuacaugggacagccccuuaacaaugacgaggaucaugcccacuggaccgaagcuaagaugcugcucgacaacauuaauacgccugagggcaucauucccgcccuguucgaaccugagcgggaaaagagcgcggccaucgauggggaguauagacugcgcggagaggcuagaaagaccuuuguggagcucaugcggcgcggcgaccuuccgguuuggcugucuuacaaaguggccuccgagggguuccaauauagcgauagacgguggugcuuugacggcgaacgcaacaaucagguccuggaggaaaacauggauguggagaucuggacaaaggagggagaacgcaaaaagcuccggcccagauggcuggacgcucgcaccuacuccgacccucuugcccugcgggaguucaaagaauuugcugccggcagacgcucugucagcggggaucucauucuggagaucggaaagcugccccagcaccucacacagcgggcgcaaaaugcccuugacaaccuggugaugcugcauaauuccgaacagggcgggagagcuuaucggcacgccauggaggagcucccugauaccauugaaacacugaugcuucuggcucucaucgccguucugaccggaggcgugaugcuguucuuucucucuggccgcgggcuuggaaagacgagcauuggccugcugugugugauggccuccagcgggcuccuguggauggcuucugucgagccccauuggaucgcggccuccaucauucuugaguucuuucugaugguucuccugaucccggagccugacagacagcggacaccccaggauaaccaacuggcuuacguggugaugggacuccuuuucaugauucugaccgucgccgccaaugagaugggccugcucgaaaccaccaaaaaggaccuggggaucggacacguggcuguugagaaccaccaucacgccgcgaugcuugauguggaccugcauccugccagcgcuuggacccucuacgccgucgcuacaacgauuaucacccccaugaugcgccacacaauugaaaacaccacagccaauaucucucugaccgcgaucgccaaccaggcugccauucugaugggccucgauaaaggcuggccuaucuccaagauggacauuggggugccccuucuggcucugggaugcuauagccaggucaauccgcucacgcugaccgccgcugugcuuaugcugguugcccauuacgcgaucauuggcccugggcuccaagccaaagcuacaagagaggcccagaagcggaccgcugccggaaucaugaagaaccccacaguggauggcaucgucgccauugaccuggaucccgugguuuaugacgcgaaauuugaaaagcagcuggggcagaucaugcuccuuauucuguguaccucucaaauccugcucaugcgcacgacaugggcucugugcgagagcauuacccuugccacaggaccucugaccacccucugggagggcuccccgggcaaauucuggaauacaacgaucgcugugucuauggccaacaucuuuagagggagcuaccuggccggagcuggccuggccuucucccucaugaaaagccuugggggaggccggcgcgggaccggagcgcagggcgaaacacugggcgagaaauggaagagacagcugaaucagcucuccaagucugaguucaacaccuauaaacggagcgggauuauggaggucgacagauccgaagccaaggagggacugaaacgcggcgagacaaccaagcacgcugugucucgggggacggccaaacuuagaugguuuguggaacgcaaucugguuaagcccgagggaaaggucaucgaucucggcugugggcggggaggcuggagcuacuauugcgcuggccugaaaaaggugacagaagugaaaggguacaccaagggaggcccugggcacgaggaacccauuccuauggccaccuacggauggaaccuggucaaacuccauuccggcaaggacguuuucuuuauucccccugagaaaugugauacacuucugugcgacaucggggagucuagcccgaaucccaccaucgaagagggaagaacacugcgcgugcucaagaugguggaaccuuggcugcggggcaaccaauucuguauuaagauccuuaaucccuauaugccuuccgucguggagacgcuggagcagaugcagagaaaacacggcgggaugcucguucgcaacccccugagcagaaauucuacccaugaaauguacuggguguccugcggaacaggcaacaucgucagcgcggugaauaugaccucuagaaugcugcucaaccgcuuuacaauggcccaccggaagccgaccuaugagagagauguugaccuggggacgggaacccgccacguggcugucgaaccugagguggccaaccuugauauuaucggccagagaauugaaaauaucaaacaugagcacaaguccacauggcauuacgacgaggauaaccccuauaaaaccugggcuuaccacgggagcuaugaagugaagcccucuggauccgccagcuccauggucaauggcguugugaagcugcucacaaaaccuugggacgugauucccauggucacccaaaucgcuaugacagauaccacgccuuucggccagcagcggguguuuaaggagaaaguugacacacgcaccccgaaggccaaaagagggaccgcgcaaaucauggaagugacagcccgguggcuguggggauuccuuagcagaaacaagaagccccggauuuguacgcgcgaggaauuuaccagaaaaguccggucuaaugcugccaucggcgcuguguucguugacgagaaccaguggaauagcgccaaggaggccguggaagaugagcgcuuuugggaccugguccauagagaacgggagcuccacaaacaggggaagugcgcgacaugcguguacaacaugaugggaaaacgcgaaaagaagcugggcgaguucgggaaagcuaagggcuccagagccauuugguacauguggcugggagcccgguuucucgaguucgaagcucugggcuucaugaaugaggaucacugguuuucucgcgaaaacagccuuuccgggguugagggagagggccugcauaaacucggguauauccugagagacauuucuaagaucccuggaggcaauauguacgccgaugacaccgcugggugggauacacggaucaccgaagacgaucuucagaacgaggccaaaauuacagacaucauggaacccgagcacgcgcugcucgccaaggcuauuuucaaacugaccuaucaaaauaaggugguccgcgugcagagaccugccaagaacggcacggucauggaugugaucagccggcgcgaccagagaggauccggccagguugggaccuacggacugaauacauuuaccaacauggaagcucaacucauucggcagauggagucugagggcaucuucagccccuccgaacuggagacaccgaaccuugccgaaagagcgcuggauuggcucgagaaauaugggguggaacgccugaagcggauggccaucagcggagacgacugugucgugaaaccuauugaugacagauuugcuaccgcccuuacggcucugaaugauaugggcaaggugcgcaaagacaucccccagugggagccuucuaagggguggaacgauuggcagcaaguucccuucugcucccaucacuuucaccagcucauuaugaaggacggccgggagaucguggucccuuguagaaaucaggaugaacuggugggacgcgcccggguuagccagggcgcuggguggucucugagagagacagccugccucggaaaauccuacgcgcaaauguggcagcugauguauuuccaucgccgggaccuuagacuggccgcuaacgccauuuguagcgccgugcccgucgauugggugccgaccucccgcacaaccuggucuauccacgcucaucaccaguggaugacgaccgaagacaugcucagcgucuggaaucggguguggauugaggaaaacccuuggauggaggauaagacacauaucuccagcugggaggacguucccuaccugggcaaaagagaagaccaauggugcgggucucuuaucggacugaccgcccgggcgacaugggcuaccaauauucagguggccaucaaccaggucagacgccucauuggcaaugagaacuaccuggauuauaugacauccaugaagcgguuuaaaaaugaaagcgaccccgagggggcccugugguga

SEQ ID NO: 18555 - RNA, 9879 nt, Artificial Sequence
  derived and/or modified CDS sequence (opt5) from DENV-1__FJ639678__SS-prME
agcgugacaaugcugcucaugcugaugcccacagcccuugcuuuccaccugacgaccagaggaggggaaccucauaugaucguguccaagcaggaacggggaaaagcccuccuguuuaagacaucugcgggcguuaacaugugcacccuuauugcuauggaccugggggagcucugugaagauacaaugaccuacaaaugcccgagaaucacagagguggaacccgacgauguggacuguuggugcaaugccaccgauacgugggucaccuauggaacauguccucaaaccggcgagcaccggcgggaccgcagaagcguggcccuggcuccccauguugggcugggacucgagacacgggccgaaaccuggauguccucugagggcgcuuggaagcagauucagcgcguggaaacgugggcccugagacacccuggcuucacagucaucgcgcuuuuucuggcccaugcuauugggaccagcaucacacagaaaggaaucauuuucauccuccugaugcuugugacccccuccauggccaugcggugcguuggcauugggaaccgcgauuuuguggagggacugucuggcgcuaccugggucgacguggugcucgagcacgggagcugugucacaacgauggccaaggauaagccuacccuggacaucgaacugcucaaaacagagguuaccaauccggcggugcugagaaaacuuugcauugaagccaaaaucuccaacacaaccacggauagccggugucccacacaaggagaggcuacccugguggaagaacaggacgccaauuucgucugccgcagaaccuuuguggaucggggcuggggcaacggguguggacucuucggcaaggggucucugauuacaugcgcuaaauuuaagugcguuaccaaacuugagggaaaaaucgugcaguacgaaaaucugaaguauuccgucaucgugacaguucacacgggcgaccagcaucaaguggggaacgagagcaccgaacacggaacaaccgccacaauuaccccucaggcccccacgucugagauccagcucaccgacuacggcgcucugacacuggauuguuccccucgcaccggccucgacuucaaugaaaugguccugcuuacaaugaaagaaaagagcuggcuggugcauaaacagugguuucucgaucugccccuuccguggaccucuggggcguccacgagccaagagacauggaacagacaggaccugcucgucaccuucaagacagcccacgcuaaaaagcaggaagugguugugcugggaucccaagagggcgccaugcacaccgcccugaccggggcuacagaaauucagacgucuggaaccacaaccaucuuugccggccaucucaagugccggcugaaaauggauaaacuuacacugaaagggaugagcuaugucauguguaccggcuccuucaagcucgagaaagaaguggcggagacgcagcacggaacaguucuggugcagauuaaguacgagggcaccgacgcuccuugcaagauccccuucagcacccaagaugaaaaaggggucacacagaauggaagacugaucaccgccaacccuauugugacagacaaggagaaacccgugaauaucgaagccgagcccccuuuuggcgagucuuauauuguuaucggggcuggagaaaaggcccuuaaacucuccugguucaagaagggcagcucuauugggaaaauguuugaggcuacggcccgcggcgcgcggagaauggccauccugggagauaccgcuugggacuucggcagcaucgggggagucuuuacauccgugggcaagcuggugcaucagauuuucgggaccgccuacggaguccucuuuucuggcgugagcuggacaaugaaaaucgggauuggcguucugcuuaccuggcugggacucaacucccgcagcacgucucuguccaugaccuguaucgcugugggccuggucacacuuuaccucggggugaugguucaggccgauagcggaugcgugauuaauuggaagggccgggaacugaaaugugggucuggaaucuucgucaccaacgaggugcacacauggaccgaacaauauaaguuucaggcggacuccccgaagagacugagcgccgcuauuggcaaagccugggaggaggggguuugcggcauccgcuccgcuacacggcucgaaaacaucauguggaagcagauuucuaaugagcugaaccauauccuucuggaaaaugacaugaaauucaccguggucgugggagauguggucggcauucucgcccaggggaagaaaaugaucagaccccaaccuauggaguacaaguauagcuggaaauccuggggaaaggccaagauuaucggcgcugacauccagaacacgacauuuauuaucgaugggcccaauaccccugaaugucccgacgaucagcgcgcguggaacauuugggagguugaggacuacggauucggcaucuuuaccacaaauauuuggcugaaacugcgggauucuuauacccaggugugcgaccacagacuuaugagcgccgcuaucaaggauuccaaagccgugcacgccgacaugggcuacuggaucgaaagcgagaagaacgaaacguggaaacucgcucgcgccucuuucauugaggucaagacauguaucuggccgaagucccauacccuguggagcaauggggugcuggaaucugagaugauuaucccuaaaauuuauggaggccccaucucccaacacaacuaccggccuggguacuucacacagaccgcgggacccuggcaucucggcaagcuggagcuugauuuugaccugugcgaagggacaaccguuguggucgaugagcacugcggaaauagaggcccuagccuccggacgaccacagugaccggcaaaaucauucacgaaugguguugccgcucuuguacacugcccccgcugagauucaagggggaggacggaugcugguauggcauggagauccggccuguuaaagaaaaggaggaaaaccuugucaagagcauggucuccgcugggagcggagagguggacucuuuuucccucggccugcuguguauuagcaucaugauugaagagguuaugagaucccgcuggucucggaaaaugcucaugaccgggacgcuggccguguucuuucuucugaucaugggacagcucacauggaaugaucugauuagacugugcaucauggucggcgccaacgcuagcgaccgcaugggcauggggaccacauaccuugcccugauggcgaccuucaagaugagacccauguuugcugugggacuccuguuccggcgccucaccuccagagaggugcugcuucugacaaucggccucucucuggucgccagcguugaacugcccaauucccuugaggaacugggggauggacucgccaugggcauuaugauccugaaacuccugacggacuuucaaucucaucagcuuugggcuacccugcucagccugacauucauuaagaccacauuuucccugcacuaugccuggaaaaccauggcuauggugcuuagcaucgugucucugcucccucugugucucuccacgacaagccagaagaccaccuggcugccgguccuucuggggucucugggaugcaagccccucacaauguuccugauugccgagaacaaaaucuggggccggaaguccuggccucuuaacgaaggcaucauggcgguggggauuguuagcauccugcucucuucccugcucaaaaaugaugugccccuggccggaccucuuauugcuggcgggaugcugaucgccuguuacgucauuagcggauccagcgcugaccugucucucgagaaggccgccgaggugagcugggaagaggaagcugagcauuccggcgcgucucacaacauccugguugaagugcaggaugacgggaccaugaaaaucaaggaugaggagcgcgacgauacacuuacgauucugcucaaagccacccugcucgcugucagcggaguguauccccuguccaucccugccacacuuuuucugugguacuucuggcaaaagaagaaacagagaucuggcguccugugggacacccccagcccgccugaaguggagcgggccguucucgaugacggcauuuaucgcaucaugcagagagggcugcuuggacggucccaggugggcgucgggguguuccaagaaaauguuuuucauacaauguggcacgugacccgcggagcuguccugauguaccagggcaagagacucgagcccucuugggccagcgugaaaaaggaccugauuuccuacgggggaggcuggcggcuccagggcagcuggaacacgggggaggaagugcagguuaucgcggucgagccuggcaagaaucccaagaacgugcaaaccgcuccgggcacauucaagaccccugaaggggaggugggagccauugcccuggauuuuaaacccggcacaucuggguccccuaucgucaauagagaaggaaagaucgugggccuuuauggcaacgggguugugaccacaagcggaacguacgucucugcuauugcccaggcgaaggcuucccaggagggcccccugcccgagaucgaagacgagguguuccgcaagcggaaucugaccauuauggaucuccacccugggagcggaaaaacaagacgcuaucugccggccaucguucgggaagccauuaagagaaaacuucgcacccugauccucgcucccacccggguggucgccuccgagauggcugaagcccugaaaggcaugccuaucagauaccaaacaacggcggugaagucugagcauaccgggaaagagauuguugaccugaugugccacgccacauuuaccaugcgccuccuuagccccgugcgggucccuaacuauaauaugaucauuauggaugaagcucauuucacagaccccuccagcaucgccgcuagaggcuacauuucuacccgggugggaaugggcgaggccgccgcuaucuuuaugacggcgacaccuccgggguccguggaagccuucccccagagcaacgcugucauccaggaugaggaacgcgacauuccugagagaucuuggaauagcggauaugaguggaucaccgauuuucccggcaagaccguuugguucgugccuuccauuaaaucugggaacgacaucgccaauugucugcggaagaacggaaagcgcgugauucagcugagcagaaaaacauuugauaccgaauaccaaaagaccaagaacaaugacugggacuacgucgugaccacggauaucuccgagaugggcgccaacuuccgggcugacagaguuauugauccccgccggugccucaagccggugauccugaaagacgggcaggaaagagucauccuugccggcccuaugcccgugacaguugcgucugcugcccagcgccggggaagaauuggccgcaaucacaacaaggagggggaucaguauaucuacaugggacaaccccugaauaacgacgaggaucaugcccacuggaccgaagcuaagaugcuccuggacaauauuaacacaccugagggcaucauucccgcccuguucgaaccugagcgggaaaagagcgcggccaucgauggggaguauagacuccgcggagaggcuagaaagaccuuuguggagcuuaugcggcgcggcgaccugccggucuggcuguccuacaaaguggccagcgagggguuccaguauucugauagacgguggugcuuugacggcgaacgcaauaaccagguccucgaggaaaauauggauguggagaucuggacgaaggagggagaacgcaagaagcugcggcccagauggcuugacgcucgcaccuacuccgacccucuggcccuccgggaguucaaagaauuugcugccggcagacgcagcguuuccggggaucugauucuggagaucggaaagcucccccagcaccuuacacaaaaggcgcagaacgcccuggacaaucuggugaugcuccauaacucugaacagggcgggcgggcuuauagacacgccauggaggagcugccugauaccauugaaacacuuaugcugcucgcucugaucgccgugcugaccggaggcgucacacucuucuuucuuagcggccgggggcugggaaaaaccuccauuggccugcucuguguuauggccucuagcgcucugcuuuggauggcguccguggagccccauuggaucgccgcuagcaucauucuggaguucuuucucauggugcugcugaucccggagccugaccgccagagaacgccccaagauaaucagcucgccuacgucgugauugggcuucuguucaugauccugacaguugccgcuaacgagaugggacuccuggaaaccaccaagaaagaccuuggcauugggcacguggccgucgagaaccaccaucacgcgacaaugcuggauguggaccuccauccugccucugcuuggacccuguacgccgucgcuacaacgaucauuacccccaugaugcggcacacaaucgaaaauaccacagccaacaucucccugaccgcgauugccaaucaggcugccauccucaugggacuugauaagggcuggccuauuagcaaaauggacaucggcgugccccugcuggcucucgggugcuauucucaaguuaacccgcugacgcuuaccgccgcugugcugaugcucgucgcccauuacgcgauuaucggaccuggccugcaggccaaggcuacacgcgaggcccagaagagaaccgcugccgggaucaugaaaaaucccacaguggauggaauuguugccaucgaccuggaucccguggucuaugacgcgaaguuugaaaaacagcucggccaaauuaugcuucugauccuguguaccucccagauucuccugaugcggacgacaugggcucuuugcgagagcaucacccuggccacagggccucucaccacccugugggagggaucuccgggcaaguucuggaacacaacgaucgcugugagcauggccaauauuuuucgcggcuccuaccuggccggggcuggacucgccuucucucuuaugaaaagccugggcgggggaagacggggcaccggggcgcagggagaaacacugggcgagaaguggaagcgccagcucaaccaacuguccaaaagcgaguucaauaccuauaagagauccggcaucauggagguggaccggucugaagccaaagaggggcuuaagagaggagagacaacccgccacgcuguuagccggggcacggccaaacugagaugguuugucgaacgcaaccucgugaagcccgaggggaaggugauugaucugggauguggcagagggggaugguccuacuauugcgcuggccugaaaaaggucacagaaguuaaaggcuacaccaaagggggaccuggccacgaggaacccaucccuauggccaccuacggguggaaucucgugaaacuucauucuggaaaggacguguucuuuauucccccugagaaaugugauacacugcugugcgacaucggcgagagcuccccgaaccccaccauugaagaggggagaacacuccgcguccugaagaugguggaaccuuggcuucggggaaaucaguucuguaucaagauccugaaccccuauaugccuucuguuguggagacgcucgagcagaugcagagaaaacacggcggcaugcugguccgcaauccccugagccggaacuccacccaugaaauguacugggugagcugcgggacaggaaauauuguuucugcggugaacaugaccuccagaaugcuccugaaccgcuuuacaauggcccaccggaagccgaccuaugagagagaugucgaccuuggcgcugggacgcgccacguggccguggaaccugaggucgcuaaucuggauaucauuggacaaagaaucgaaaacauuaaacaugagcacaagagcaccuggcauuacgacgaggauaaucccuauaaaacaugggccuaccacggcucuuaugaaguuaagcccuccgggagcgcuucuuccauggugaacggaguggucaagcuccugaccaaaccuugggacgugauccccaugguuacacagaucgccaugaccgauacaaccccuuucggccagcaacggguguuuaaggagaaagucgacacgcgcacaccgaaggcgaaacagggcaccgcccagauuauggaagugaccgcuagauggcuuuggggguuccugagccggaauaagaagcccagaaucuguacacgggaggaauuuacgcgcaaaguuagauccaacgccgcuauuggagccguguucgucgacgagaaucaguggaacagcgccaaggaggcgguggaagaugagcgguuuugggaccucguucaucgcgaaagagagcugcacaaacaaggcaagugcgcuaccugcguguacaauaugauggggaaacgggaaaagaagcugggagaguucggcaaagccaaggggucucgcgccaucugguacauguggcucggcgcuagauuucuggaguucgaagcccuuggauucaugaacgaggaucacugguuuagccgggaaaauucccugucuggcgucgagggggagggacuccauaaacugggcuauauucuucgcgacaucagcaagaucccugggggaaacauguacgcugaugacacagccggcugggauaccagaauuacagaagacgaucugcggaaugaggcgaaaaucaccgacauuauggaacccgagcacgcccuccuggcuacauccaucuucaagcugaccuaucagaacaaagugguccgcgugcagagaccugccaagaaugggacgguuauggaugugauuucucggcgcgaccagagaggcagcggacaagucggcaccuacgggcucaacacauuuaccaacauggaagcucagcugauccggcagauggaguccgagggaaucuucucucccagcgaacuugagacaccgaaucuggccgaaagagugcucgauuggcuggagaaguauggcguggaacgccuuaaacggauggcgauuuccggggacgacuguguugugaagccuaucgaugacagauuugccaccgcucugacggcccucaacgauaugggaaaaguccgcaaggacauuccccagugggagccuagcaaaggcuggaaugauuggcaacaggugcccuucugcucucaucacuuucaccagcugaucaugaaggacgggcgggagauuguugugccuuguagaaaccaggaugaacuggucggccgcgcucgggugucccaaggagccggcuggagccucagagagacagcuugccuggggaagucuuacgcccagauguggcagcuuauguauuuccaucgccgggaccugagacucgcggccaaugcuaucuguuccgccguccccguggauuggguuccgaccagccgcacaaccugguccauucacgcccaucaccaauggaugacgaccgaagacaugcugucuguguggaaccgggucuggaucgaggaaaauccuuggauggaggauaaaacacauaucagcuccugggaggacgugcccuaccuuggaaagagagaagaccaguggugcggcagccugauugggcucaccgcucgggccacaugggcgaccaacauccagguugcuauuaaucaggugagacgccugaucggaaacgagaauuaccuggauuauaugacaucuaugaaacgguuuaagaacgaauccgaccccgagggcgcccucugguga

SEQ ID NO: 18556 - RNA, 9879 nt, Artificial Sequence
  derived and/or modified CDS sequence (opt5) from DENV-1__FJ639679__SS-prME
agcgugaccaugcugcucaugcugaugcccaccgcccuugcuuuccaccugacgaccagaggcggggagccucauaugaucguguccaagcaggaacggggaaaaucucuccuguuuaagaccagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaaguucacagugguugugggagaugucgcuggcauccucgcccaggggaaaaagaugauucggccgcaacccauggaguacaaauauucuuggaaaagcuggggaaaggccaagaucaucggcgcugacgugcagaauaccaccuuuauuaucgaugggccuaacacacccgaauguccugacgaucagagagcguggaauauuugggagguggaggacuacggauucggcaucuuuaccacgaacauuuggcugaagcugcgcgauuccuauacacaggucugcgaccaccggcuuaugagcgccgcuaucaaagauucuaaggccguucacgccgacaugggcuacuggaucgaauccgagaaaaaugaaaccuggaagcucgcuagagccagcuucauugaggugaagacauguaucuggcccaaaucucauacccugugguccaacggggugcuggaaagcgagaugauuaucccgaagauuuauggaggcccuaucucucaacacaauuaccgccccggguacuucacacagaccgcgggaccuuggcaucucggcaaacuggagcuugauuuugaccugugcgaagggacgaccgucgugguugaugagcacugcggaaaccggggccccagccucagaacaaccacagugaccggcaagaucauucacgaaugguguugccgguccuguacgcugccuccccugcgcuucagaggggaggacggaugcugguauggcauggagauccggccggucaaagaaaaggaggaaaaucuugucaagagcaugguuucugcuggguccggagagguggacagcuuuucccucggccugcuguguauuucuaucaugauugaagaggucaugagaagccgcuggucccggaaaaugcucaugacagggacccuggccguguuccuucugcucaucaugggacagcugacauggaacgaucugauuagacuuugcaucaugguuggcgccaaugcuucugaccgcaugggcauggggaccaccuaccuggcccucauggcgacauuuaagaugagaccuauguucgcugugggacugcucuuucggcgccugacgagcagagagguccuucugcucaccaucggccugucccugguggccucuguggaacuucccaacagccuggaggaacucggggauggacuggccaugggcauuaugauccucaaacugcuuacagacuuccaaucccaucagcugugggcuacccuccugagccugacauuuauuaagaccacguucucucuucacuaugccuggaaaacaauggcuaugguccuguccaucguuagccucuuuccccugugucucucuaccaccucccagaagacaaccuggcugccugugcuucuggggagccugggaugcaagccgcucacaauguuccugauugccgagaauaaaaucuggggccggcgcucuuggccccuuaacgaaggcaucauggcgguggggauugucuccauccugcucagcucccugcucaagaacgaugugccucuggccggaccccuuauugcuggcgggaugcugaucgccuguuacguuauuagcggaucuagcgcugaccugucccucgagaaagccgccgaggugucuugggaagaggaagcugagcauagcggcgcgucccacaauauccuggucgaagugcaggaugacgggacgaugaagaucaaagaugaggagagagacgauacccuuacaauucugcucaaggccacccugcucgcuguuucuggaguguauccucugagcauccccgccacacuuuuugucugguacuucuggcagaagaagaagcagcgguccggcgugcugugggacaccccuucucccccggaagucgagcgcgccgugcuggaugacggcauuuauagaaucaugcagcgggggcuccugggacgcagccagguuggcgugggggucuuccaagaaaacguguuucauacgauguggcacguuaccagaggagcugugcuuauguaccagggcaaacggcuggagccuuccugggccagcgucaagaaagaccucauuucuuacgggggaggcuggagacugcagggcuccuggaauacaggggaggaagugcaagugaucgcgguugagcccggaaagaacccuaaaaauguccaaaccgcucccggcacauucaagaccccggaaggggaggugggagccauugcccucgauuuuaagccuggcacaagcgggucucccaucgugaaccgcgaaggaaaaaucgucggccuguauggcaauggggugguuacgaccuccggaacauacgugagcgcuauugcccaggcgaaggcuucccaggagggcccucuucccgagaucgaagacgaggucuuccggaaaagaaaccugaccauuauggaucugcaccccgggucuggaaagacccgccgguaucucccugccaucgugagagaagccauuaaacgcaagcugcggacacuuauccuggcuccgacgagaguuguggccagcgagauggcugaagcccucaagggcaugcccauccgcuaccaaaccacagcggucaaauccgagcauaccgggaaggagauuguggaccugaugugccacgccacauuuaccaugcggcugcucagcccuguuagagugcccaauuauaacaugaucauuauggaugaagcucauuucacggacccuucuuccaucgccgcucggggcuacauuagcacacgcgucggaaugggcgaggccgccgcuaucuuuaugaccgcgacacccccugggucuguggaagccuucccgcagagcaaugcugugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacauuugauaccgaauaccagaaaacgaagaacaacgacugggacuacguggucacaaccgauaucagcgagaugggcgccaauuucagagcugaccgcgugauugauccucggagaugccugaaacccguuauccucaaggacgggccggaacgcgugauccuggccggcccuaugcccgucacaguggcguccgcugcccagcggagaggacgcauuggccggaaccacaauaaagagggggaucaguauaucuacaugggacagccccuuaacaaugacgaggaucaugcccacuggaccgaagcuaagaugcugcucgacaacauuaauacgccugagggcaucauucccgcccuguucgaaccugagagagaaaagagcgcggccaucgauggggaguaucgccugagaggagaggcucggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcgcaaaaugcccuugacaaccugguuaugcugcauaauuccgaacagggcgggcgggcuuaucgccacgccauggaggagcucccugauaccauugaaacacugaugcuucuggcucucaucgccgugcugaccggaggcgugacgcuguucuuucucucuggcagagggcuuggaaagacaagcauuggccugcugugugucauggccuccagcguucuccuguggauggcuucuguggagccccauuggaucgcggccuccaucauucuugaguucuuucugauggugcuccugaucccggagccugaccggcagcgcacaccccaggauaaccaacuggcuuacgucgugauugggcuccuuuucaugauccugaccguugccgccaaugagaugggacugcucgaaacaaccaagaaagaccugggcauugggcacguggcugucggaaaccaccaucacgccgcgaugcuugauguggaccugcauccugccagcgcuuggacacucuacgccgucgcuacgaccaucauuacacccaugaugagacacaccaucgagaacacaaccgccaauaucucucugacggcgauugccaaccaggcugccauccugaugggccucgauaagggcuggccuauuuccaaaauggacaucggggugccccuucuggcucugggaugcuauagccagguuaauccgcucacccugacagccgcugugcuuaugcuggucgcccauuacgcgauuaucggcccugggcuccaagccaaggcuacccgggaagcccagaaacgcacagcugccggaaucaugaagaaccccaccguggauggcauuguugccaucgaccuggaucccguggucuaugacgcgaaguuugagaaacagcuggggcagauuaugcuccuuauccuguguacgucucaaauucugcucaugagaacaaccugggcucugugcgaaagcaucacacuugccaccggaccucugaccacacucugggagggcuccccgggcaaguucuggaauacgaccaucgcugugucuauggccaacauuuuucgggggagcuaccuggccggagcuggccuggccuucucccucaugaaaagccuugggggaggccgcagagggacaggagcgcagggcgagacccugggcgaaaaguggaaacggcagcugaaucagcucuccaagucugaguucaacacauauaagagaagcgggaucauggaaguggaccgcuccgaggccaaagaaggacugaagcggggcgagaccacgaaacacgcuguuucuagagggacagccaaacuucgcugguuugucgagcggaaucuggugaaacccgaaggaaaggugauugaucucggcugugggagaggaggcuggagcuacuauugcgcuggccugaagaaagucaccgagguuaagggguacaccaaaggaggcccugggcacgaagaacccaucccuauggccacauacggauggaaccuggugaagcuccauuccggcaaagacguguucuuuauucccccugaaaagugugauacccuucugugcgacaucggggagucuagcccgaaucccacaauugaggaaggacgcacgcugcggguccucaaaaugguggagccuuggcugagaggcaaccaauucuguaucaagauccuuaaucccuauaugccuuccguuguggaaacccuggagcagaugcagcgcaagcacggcgggaugcucguccggaacccccugagcagaaauucuacacaugagauguacuggguguccugcggaaccggcaacauuguuagcgcggugaauaugacaucucgcaugcugcucaaccgguuuaccauggcccacagaaaaccgacguaugaacgcgaugucgaccugggggcuggaaccagacacguggccguggagccugaagucgcuaaccuugauaucauuggccagcggaucgagaauauuaagcaugaacacaaauccacauggcauuacgacgaggauaaccccuauaagaccugggccuaccacgggagcuaugagguuaaacccucuggauccgcuagcuccauggugaauggcguggucaagcugcucacaaagccuugggacgugauccccaugguuacccaaaucgccaugacagauaccacgccuuucggccagcagcgcguguuuaaagaaaaggucgacacaagaaccccgaaagcgaagcgggggaccgcccaaauuauggaggugacagcuaaauggcuguggggauuccuuagcagaaacaagaagccccggaucuguacgcgcgaagaguuuaccagaaaaguucggucuaaugccgcuauuggcgccguguucgucgacgaaaaccaguggaauagcgccaaggaggcgguggaggaugaacgcuuuugggaccugguucauagagagcgggaacuccacaaacaggggaagugcgcuacaugcguguacaacaugaugggaaaacgcgagaagaagcugggcgaguucgggaaagccaagggcuccagagccaucugguacauguggcugggagcucgguuucucgaguucgaggcccugggcuucaugaaugaagaucacugguuuucucgcgagaacagccuuuccggggucgaaggagagggccugcauaaacucggguauauucugagagacaucucuaagaucccuggaggcaauauguacgcugaugacaccgccgggugggauacacggauuaccgaggacgaucuucagaacgaagcgcgcaucacagacauuauggagcccgaacacgcccugcucgcuaaaagcaucuucaagcugaccuaucaaaauaaaguggucagagugcagcggccugccaagaacggcacgguuauggaugugauuucccgcagagaccagcggggaucuggccaggucgggaccuacggacugaauacauuuaccaacauggaggcucaacucaucagacagauggaaagcgagggcaucuucucccccagcgagcuggaaacaccgaaccuugccgcgcgcgugcuggauuggcucgagaaguaugggguggaacggcugaaaagaauggccauuucuggagacgacuguguugugaagccuaucgaugaccgcuuugcuaccgcccuuacggcucugaaugauaugggcaaaguccggaaggacauuccccagugggagccuuccaaaggguggaacgauuggcagcaagugcccuucugcagccaucacuuucaccagcucaucaugaaggacggcagagaaauuguugugccuugucgcaaucaggaugagcuggucggacgggccagagugucucagggcgcuggguggucccugcgcgagacagccugccucggaaagagcuacgcgcaaauguggcagcugauguauuuccaucggagagaccuucgccuggccgcuaacgccaucuguuccgccguccccguggauuggauuccgaccucucggacaaccuggagcauccacgcucaucaccaguggaugacgaccgaagacaugcucuccguuuggaauagaguguggaucgaggaaaacccuuggauggaggauaaaacacauauuagcucuuggggcgacguccccuaccuggggaagcgggaagaccaauggugcggaucccuuaucggccugaccgccagagcgacaugggcuaccaauauucagguggccaucaaccagguucgccggcucauugggaaugagaacuaccuggauuauaugacaagcaugaaaagauuuaagaaugagucugaccccgaaggcgcccugugguga

SEQ ID NO: 18557 - RNA, 9879 nt, Artificial Sequence
  derived and/or modified CDS sequence (opt5) from DENV-1__FJ850069__SS-prME
agcgugaccaugcugcucaugcugaugcccacagcccuugcuuuccaccugacgaccagaggcggggagccucauaugaucgucggaaagcaggaacggggcaaaucccuccuguuuaagacaucugccgggguuaacaugugcacccuuauugcgauggaccugggagagcucugugaagauacaaugaccuacaaaugcccgcgcaucacagagguggaacccgacgauguggacuguuggugcaauaccacggauaccugggucacauauggcaccuguagccaaacaggggagcacagacgggacaagcgcuccguggcucuggccccucauguuggacugggccucgagaccagagccgaaacguggaugucuagcgagggcgcuuggaaacagauucagcggguggaaacaugggcccugcgccaccccggguucaccgucaucgcucuuuuucuggcccaugugauuggaacauccaucacccagaagggcaucauuuucauccuccugaugcuuguuaccccuucuauggcgaugagaugcguggggauuggaagccgggauuuugucgagggccuguccggggccacauggguggacgugguccucgagcacggaagcuguguuacgaccauggcuaaggauaaacccacacuggacaucgaacugcucaagaccgaggugacaaacccugccgugcugcgcaaacuuugcauugaagcuaagaucucuaauaccacgacagauuccagauguccgacccaaggcgaggccacccuggucgaagagcaggacgcgaacuucgugugccggcgcacauuuguugauagaggcugggggaauggauguggccucuucgggaaaggaagccugauuaccugcgccaaguuuaagugcgugacaaaacuugagggcaagaucguccaguacgaaaaccugaaauauucugugaucguuacggugcacaccggggaccagcaucaagucggaaaugaguccacagaacacggcaccacagcuaccauuacgccccaggccccuaccagcgagauccagcucacagacuacggcgcucugacccuggauuguucuccccggacagggcucgacuucaacgaaauggugcugcuuaccaugaaggagaaauccuggcugguccauaagcagugguuucucgaucugccucuucccuggacgagcggagccuccacaucucaagagaccuggaaucgccaggaccugcucgugacauucaaaaccgcccacgcuaagaagcaggaaguugugguccugggcagccaagagggggcgaugcacaccgcccugacaggagcuacggaaauucagaccuccggcacaaccacaaucuuugccgggcaucucaaaugcagacugaagauggauaaacuuacccugaagggcaugagcuaugugauguguacgggaucuuucaaacucgagaaggaaguugccgagacacagcacggcaccgugcugguccagauuaaguacgaggggaccgacgcuccgugcaaaaucccuuucuccacacaagaugaaaagggagugacccagaacggccggcugaucacagccaaucccauugugacggacaaagagaagccuguuaacaucgaagcggagccccccuuuggggagagcuauauugucaucggagcuggcgaaaaagcccuuaagcucucuugguucaagaaagggagcuccauuggcaagauguuugaggccaccgcuagaggagcccgccggauggcuauccugggcgauacagccugggacuucgggucuaucggaggcguguuuaccagcguggggaaacugguccaucagauuuucggaacagcguacggcgugcucuuuuccgggguuagcuggaccaugaagaucggcauuggagugcugcuuacguggcugggccucaauucuagauccaccagccugucuaugacauguaucgccgucgggcuggugacccuuuaccucggaguuauggugcaggcugauuccggcugcgucauuaacuggaaagggcgcgaacugaaguguggaagcggcaucuucgugacaaaugagguucacaccuggacagaacaauauaaguuucaggccgacuccccuaaacggcugucugcugccauugggaaggcgugggaggagggcgugugcggaaucagaagcgccacccgccucgaaaacaucauguggcggcagauuuccaacgagcugaaucauauccuucuggaaaacgacaugaaauucacggucguggugggcgaugucguugggauucucgcucagggaaagaaaaugaucagaccgcaacccauggagcacaaguacucuuggaaaagcuggggcaaggccaagauuaucggggcugacgugcagaauacaaccuuuaucauugauggaccuaacacccccgaauguccugacgaucagcgcgccuggaauaucugggagguggaggacuauggcuucggcauuuuuacaaccaacaucuggcugaaacugcgggauuccuacacgcaggucugcgaccacagacuuaugagcgccgcuauuaaggauucuaaagcggugcaugccgacaugggguauuggaucgaauccgagaagaaugaaacauggaaacucgcucgcgccagcuucaucgagguuaagaccuguauuuggcccaagucucacacacugugguccaacggagugcuggaaagcgagaugaucauuccgaaaaucuacggcgggccuauuucucaacauaauuaucggcccggauacuucacccagacagccggcccuuggcaccucgggaagcuggagcuugauuuugaccugugcgaaggaaccacggucgugguugaugagcacugcggcaacagaggccccagccuccggaccacaaccgugacagggaaaaucauccaugaaugguguugccgcuccuguacccugccuccccugagauucaagggagaggacggcugcugguacgggauggagauucggccggucaaagaaaaggaggaaaaucuugugaagagcaugguuucugcuggauccggcgagguggacagcuuuucccucgggcugcuguguaucucuauuaugaucgaagaggucaugagaagccgcuggucccggaaaaugcucaugacgggaacacuggccguguucuuucuucugauuaugggccagcucaccuggaacgaucugaucagacugugcauuauggugggcgcgaaugcuucugaccgcauggggaugggaacaaccuaucuugcccugauggccaccuucaagaugagaccuauguuugcugucggccuccuguuccggcgccucacaagcagagagguucugcuucugacgaucgggcucucccugguggccucuguggaacugcccaacagccuugaggaacugggagauggccucgcgauggggaucaugauucugaaacuccugaccgacuuucaauccuaccagcuuugggucacacugcucagccugaccuucaucaagacaaccuuuucucugcacuaugcuuggaaaacgauggccauggugcuuuccauuguuagccugcucccccugugucucucuacaaccucccagaagaccacauggcugccugugcuucugggaagccugggcugcaagccgcucaccauguucuuuaucgccgagaauaaaauuuggggccggaagucuuggccccugaacgaagggaucauggcugucggaaucguguccauucuucugagcucccuccugaaaaacgauguuccucucgccggcccccugaucgcugggggaaugcuuauugccuguuacgugaucagcggcucuagcgcggaccugucccuggagaaggccgcugaggucucuugggaagaggaagccgagcauagcggggcuucccacaauauucucguggaaguccaggaugacggaacaaugaaaaucaaggaugaggagcgcgacgauacgcugaccauccuucugaaagccacacuccuggccgugucuggcguuuauccucucagcauucccgcuacccuguucgugugguacuucuggcaaaagaagaaacagagauccggcguccuuugggacacaccuucucccccggaaguggagcgggcgguucuggaugacgggaucuaucgcauuaugcagagaggacugcucggccggagccaggugggggucggaguguuucaagaaaacguguuccauaccauguggcacguuacgcgcggcgccguccugauguaccaggggaagagacuugagccuuccugggcuagcgugaaaaaggaccugaucucuuacggaggcggcuggcggcuccagggguccuggaauaccggagaggaagugcaggucauugccguggagcccggcaaaaacccuaagaauguucaaacagcccccgggaccuuuaagacaccggaaggagaggugggcgcuaucgcccuggauuucaaaccugggaccagcggaucucccauugucaacagagaaggcaagaucgugggccucuaugggaauggaguugugacaacguccggcaccuacgucagcgcgaucgcucaggccaaagccucccaggaggggccucugcccgagauugaagacgagguguuucgcaagcggaaccuuacaaucauggaucugcaccccggaucuggcaaaaccagacgcuaucugccugcuauuguucgggaagccaucaagagaaagcuccgcacccugauucuugcgccgacacggguggucgcuagcgagauggccgaagcccugaaagggaugcccaucagauaccaaacgaccgcugugaaguccgagcauacaggccgcgagaucguggaccucaugugccacgccaccuucacaaugcggcugcugagcccugucagaguucccaauuauaacaugauuaucauggaugaagcucauuuuaccgacccuucuuccauugccgcgcggggauacaucagcacgcgcgugggcaugggggaggccgcugccauuuucaugacagcuacccccccuggaucuguggaagccuuuccgcagagcaaugccgucauccaggaugaggaaagagacauccccgagcgguccuggaacucuggcuaugaguggauuaccgauuucccugggaaaacagugugguuuguucccagcaucaaguccggaaaugacauugcuaacugucuccgcaaaaauggcaagagagugauccagcuuucucggaagaccuucgauacagaauaccaaaaaaccaagaacaacgacugggacuacgucgugacgacagauauuagcgagaugggggcgaauuucagagccgaccgcguuaucgauccucggagaugccugaaacccgugauucugaaggacggcccggaacgcgucauccucgcuggaccuaugcccgugaccgucgccuccgccgcucagcggagaggccgcaucgggcggaaccacaauaaagagggagaucaguauauuuacaugggccagccccugaacaaugacgaggaucaugcccacuggacagaagcgaagaugcuucuggacaacaucaauaccccugaggggauuauccccgcucucuuugaaccugagagagaaaagagcgccgccauugauggagaguaucgccugagaggcgaggcucggaaaacguucguggaacugaugcgcagaggggaccucccgguuuggcuuucuuacaagguggccuccgagggcuuucaauauagcgaucggcgcuggugcuucgacggagaaagaaacaaucaggugcuggaggaaaacauggaugucgagaucuggaccaaagagggcgaacggaagaaacugagaccccgcuggcucgacgcgcggacauacuccgacccucuggcccuuagagaguuuaaggaauucgcugccgggcgccggucuaucagcggagaucugauucucgagaucggcaaacugccccagcaccugacccagagagcucaaaaugcccucgacaaccuuguuaugcugcauaauuccgaacaggggggacgggcuuaucgccacgccauggaggagcugccugauacaauugaaacccucaugcugcuugcgcugaucgccgugcucacaggcggcgugacccuguuuuuccugucugggagaggacucggcaagacgagcauugggcuucugugugucauggcuuccagcgcccugcucuggauggcuucuguggagccccauuggaucgccgccuccaucauucuggaauuuuuccuuaugguucugcucaucccggagccugaccggcagcgcacaccccaggauaaccaacuggcuuacguggucauuggacugcucuuuaugauccuuaccguggcggccaaugagaugggccugcuggaaaccacaaagaaagaccucgggauuggacacgucgcuguggagaaccaccaucacgccaccaugcuggauguugaccuucauccugccagcgcuuggacacuguacgccguggcgacgaccaucauuacacccaugaugagacacaccaucgaaaacacaaccgccaauaucucucucacggcuauugccaaccaggcugccauccugaugggccuggauaagggcuggccuauuuccaaaauggacaucggggucccccuccuugcgcugggaugcuauagccaggugaauccgcugacccucacagccgcuguucugaugcuuguggcccauuacgcuauuaucggcccugggcugcaagccaaggcuacccgggaggcccagaaacgcacagcggccggaaucaugaagaaccccaccgucgauggcauuguggcuaucgaccucgaucccgugguuuaugacgccaaguucgaaaaacagcuggggcagauuaugcugcucauccuuuguacgucucaaauucugcugaugagaacaaccugggcucucugcgagagcaucacacuggccaccggaccucuuaccacacugugggagggcuccccgggcaaguuuuggaauacgaccaucgccgucucuauggcgaacauuuuccgggggagcuaccucgcuggagccggccuggcuuucucccugaugaaaagccucgggggaggccgcagagggacaggagcccagggcgaaacccuuggcgagaaguggaaacggcagcugaaucagcuguccaagucugaauuuaacacauauaagagaagcgggauccucgagguggaccgcuccgaagccaaagagggacugcggagaggcgagaccacgaagcacgcugugucucgcgggacagccaaacuucggugguucgucgaaagaaaucugguuaagcccgagggaaaagugauugaucucggcugugggcgcggaggcuggagcuacuauugcgcgggccugaagaaggugaccgaagucaaaggguacaccaagggaggcccugggcacgaggaacccaucccuauggccacauacggauggaaccuggugaaacuccauuccggcaaggacguuuuuuucauucccccugagaaaugugauacccuucugugcgacaucggggagucuagcccgaaucccacaauugaagagggacggacgcugagagugcucaagauggucgaaccuuggcugcgcggcaaccaauuuuguaucaaaauccuuaaucccuauaugccuuccgugguugagacccuggagcagaugcagcggaagcacggcgggaugcucgugagaaacccccugagccgcaauucuacacaugaaauguacugggucuccugcggaaccggcaacauugugagcgcugugaauaugacaucucggaugcugcucaacagauucaccauggcccaccgcaagccgacguaugagagagaugucgaccugggggcuggaacccggcacguugccguggaaccugagguggcgaaccuugauaucauuggccagcgcaucgaaaauauuaaacaugagcacaaguccacauggcauuacgacgaggauaaccccuauaaaaccugggccuaccacgggagcuaugaagucaagcccucuggauccgcuagcuccauggugaauggcguugugaaacugcucacaaagccuugggacgucauccccauggugacccaaaucgccaugacagauaccacgccuuuuggccagcagagaguuuucaaggagaaaguggacacacggaccccgaaggcuaaaagagggaccgcccaaauuauggaagucacagcuggauggcuguggggcuuucuuagccggaacaagaaaccccgcaucuguacgagagaggaauucacccggaaggugcgcucuaaugccgcgauuggggccguuuuuguggacgagaaccaguggaauagcgcuaaggaggccgucgaagaugagagauucugggaccuggugcaucgggaacgcgagcuccacaaacagggaaagugcgcuacaugcgucuacaacaugaugggcaaaagagaaaagaaacugggggaguuuggcaaggccaagggaucccgggccaucugguacauguggcugggcgcgcgcuuccucgaguucgaagcucugggguuuaugaaugaggaucacugguucucuagagaaaacagccuuuccggaguggagggcgaggggcugcauaaacucggauauauucugcgggacaucucuaagaucccuggcgggaauauguacgccgaugacaccgccggcugggauacacgcauuaccgaagacgaucuucagaacgaggcuaaaaucacagacauuauggaacccgagcacgcccugcucgcuaccagcaucuuuaagcugacguaucaaaauaaaguugugagaguccagcggccugccaagaacggaaccgugauggaugugauuucccgcagagaccagcggggcucugggcagguuggaacauacggccugaauaccuucacaaacauggaagcgcaacucaucagacagauggagagcgaggggaucuuuucccccagcgaacuggagaccccgaaccuugccgaacgcgugcuggauuggcucgagaaauauggagucgaacggcugaagagaauggcuauuucuggcgacgacugugugguuaagccuaucgaugaccgcuucgccacggcucuuacagcccugaaugauauggggaaagugcggaaggacauuccccagugggagccuuccaaaggcuggaacgauuggcagcaaguccccuuuugcagccaucacuuccaccagcucaucaugaaggacggaagagagauuguggucccuugucgcaaucaggaugaacuggugggccgggcgagaguuucucagggggccggauggucccugcgcgagaccgcuugccucggcaaaagcuacgcccaaauguggcagcugauguauuuucaucggagagaccuucgccuggcugccaacgcuaucuguuccgccgugcccgucgauugggugccgacaucucggaccacguggagcauucacgcgcaucaccaguggaugaccacagaagacaugcucuccguuuggaauagaguguggaucgaggaaaacccuuggauggaggauaagacccauaucagcucuugggaggacguccccuaccuggggaagcgggaagaccaauggugcggaucccuuauuggccugacagccagagcuaccugggccacaaauauccagguggccauuaaccaggugcgccggcucaucgggaaugagaacuaccuggauuauaugaccagcaugaaaagauucaagaaugaaucugacacggagggcgcucugugguga

SEQ ID NO: 18558 - RNA, 9879 nt, Artificial Sequence
  derived and/or modified CDS sequence (opt5) from DENV-1__FJ639680__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaacaugugcacccuuauugcgauggaccugggggaacucugugaagauacaaugaccuacaaaugccccagaaucacagaagcugaacccgacgauguggacuguuggugcaaugccaccgauacgugggugaccuauggaacauguucccaaaccggcgagcaccggcgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggcccaggggaaaaagaugauccggccgcaacccauggaguacaaauauucuuggaaaagcuggggaaaggccaagauuaucggcgcugacgcgcagaauaccaccuucaucauugaugggccuaacacacccgaauguccugacgaucagagagccuggaauaucugggagguggaggacuacggauuuggcauuuucaccacgaacaucuggcugaaacuucgcgauuccuauacacaggucugcgaccaccggcucaugagcgcugccauuaaagauucuaaggccguucacgcugacaugggcuacuggaucgaauccgagaaaaaugaaaccuggaagcuggccagagcgagcuuuaucgaggugaagacauguauuuggcccaaaucucauacccugugguccaacggggugcucgaaagcgagaugaucauuccgaagaucuauggaggcccuauuucucaacacaauuaccgccccggguacuucacacagaccgcuggaccuuggcaucugggcaaacuugagcuggauuucgaccucugcgaagggacgaccgucgugguugaugagcacugcggaaaccggggccccagccugagaacaaccacagugaccggcaagaucauccacgaaugguguugccgguccuguacgcugccuccccuucgcuuuagaggggaggacggaugcugguauggcauggagauucggccggucaaagaaaaggaggaaaaucucgucaagagcaugguuucugccggguccggagagguggacagcuucucccugggccugcucuguaucucuauuaugaucgaagaggucaugagaagccgcuggucccggaaaaugcugaugacagggacccuugccguguuuuuccugcucauuaugggacagcugacauggaacgaucugaucagacuuugcauuaugguuggcgcuaaugccucugaccgcaugggcauggggaccaccuaccuggcgcucauggcuacauuuaagaugagaccuauguucgccgugggacugcucuuucggcgccugacgagcagagagguccuucugcucaccaucggccugucccugguggccucuguggaacuucccaacagccuggaggaacucggggauggacuggcuaugggcaucaugauucucaaacugcuuacagacuuccaaucccaucagcugugggccacccuccugagccugacauuuaucaagaccacguucucucuucacuaugcuuggaaaacaauggccaugguccuguccauuguuagccucuuuccccugugucucucuaccaccucccagaagacaaccuggcugccugugcuucuggggagccugggaugcaagccgcucacaauguuccugaucgcggagaauaaaauuuggggccggaagucuuggccccuuaacgaaggcaucauggccguggggaucgucuccauucugcucagcucccugcucaaaaacgaugugccucuggcuggaccccuuaucgccggcgggaugcugauugcuuguuacguuaucagcggaucuagcgccgaccugucccucgagaaggccgcugaggugucuugggaagaggaagcggagcauagcggcgccucccacaauauucuggucgaagugcaggaugacgggacgaugaaaaucaaggaugaggagcgcgacgauacccuuacaauccugcucaaagcuacccugcucgccguuucuggaguguauccucugagcauucccgccacacuuuuugucugguacuucuggcaaaagaagaaacagagauccggcgugcugugggacaccccuucucccccggaagucgagcgggcugugcuggaugacggcaucuaucgcauuaugcagagagggcuccugggacggagccagguuggcgugggggucuuccaagaaaacguguuucauacgauguggcacguuacccgcggagccgugcuuauguaccagggcaagagacuggagccuuccugggcgagcgucaaaaaggaccucaucucuuacgggggaggcuggcggcugcagggcuccuggaauacaggggaggaaguccaggugauugcuguugagcccggcaagaacccuaagaauguccaaaccgcccccggcacauucaagaccccggaaggggaggugggagccaucgcucucgauuuuaaaccuggcacaagcgggucucccauugugaacagagaaggaaagaucgucggccuguauggcaauggggugguuacgaccuccggaacauacgugagcgccaucgcgcaggcuaaagccucccaggagggcccucuucccgagauugaagacgaggucuuccgcaagcggaaccugaccaucauggaucugcaccccgggucuggaaaaaccagacgcuaucucccugccauugugcgggaagcuaucaagagaaagcugcgcacacuuauucuggccccgacgcggguuguggcuagcgagauggccgaagcgcucaaaggcaugcccaucagauaccaaaccacagccgucaaguccgagcauaccgggaaagagaucguggaccugaugugccacgcuacauuuaccaugcgccugcucagcccuguucgggugcccaauuauaacaugauuaucauggaugaagcccauuucacggacccuucuuccauugcugccagaggcuacaucagcacacgggucggaaugggcgaggccgcugcgauuuuuaugaccgccacacccccugggucuguggaggcuuucccgcagagcaaugccgugauccaggaugaggaacgcgacauccccgagagauccuggaacucuggauaugaguggauuacagauuuuccuggcaagaccgucugguucguucccagcaucaaauccgggaaugacauugccaacugucuucggaagaauggaaagcgcgugauccagcugucuagaaaaacauuugauaccgaauaccaaaagacgaaaaacaacgacugggacuacguggucacaaccgauauuagcgagaugggcgcuaauuuccgggccgacagagugaucgauccucgccggugccugaagcccguuauucucaaagacgggccggaaagagugauccuggcgggcccuaugcccgucacaguggcuuccgccgcccagcgccggggaagaaucggccgcaaccacaauaaggagggggaucaguauauuuacaugggacagccccuuaacaaugacgaggaucaugcucacuggaccgaagccaagaugcugcucgacaacaucaauacgccugagggcauuauccccgcgcuguucgaaccugagcgggaaaagagcgccgcuauugauggggaguauagacugcgcggagaggccagaaagaccuuuguugagcucaugcggcgcggcgaccuuccgguguggcugucuuacaaagucgcuuccgagggguuccaauauagcgauagacgguggugcuuugacggcgaacgcaacaaucaggugcuggaggaaaacauggaugucgagaucuggacaaaggagggagaacgcaagaagcuccggcccagauggcuggacgcccgcaccuacuccgacccucuugcucugcgggaguucaaagaauuugccgcgggcagacgcucugugagcggggaucucauccuggagauuggaaagcugccccagcaccucacacagcgggcccaaaaugcucuugacaaccugguuaugcugcauaauuccgaacagggcgggagagccuaucggcacgcuauggaggagcucccugauaccaucgaaacacugaugcuucuggcccucauugccgugcugaccggaggcgugacgcuguucuuucucucuggccgcgggcuuggaaagacaagcaucggccugcugugugucauggcuuccagcguucuccuguggauggcgucuguggagccccauuggauugccgcuuccaucauccuugaguucuuucugauggugcuccugauuccggagccugacagacagcggacaccccaggauaaccaacuggccuacgucgugaucgggcuccuuuucaugauucugaccguugccgcuaaugagaugggacugcucgaaacaaccaaaaaggaccugggcaucgggcacguggccgucgagaaccacaaccaugcggccaugcuugauguggaccugcacccugcuagcgccuggacacucuacgcugucgccacgaccauuaucacacccaugaugcgccauaccauugaaaauacaaccgcgaacaucucucugacggccaucgcuaaucaggccgcuauucugaugggacucgauaaaggcuggccuaucuccaagauggacauuggcgugccccuucuggcccuggggugcuauagccagguuaacccgcucacccugacagcugccgugcuuaugcuggucgcgcacuacgccaucauuggaccuggccuccaagcuaaagccaccagagaggcucagaagcggacagccgccgggaucaugaagaaucccaccguggauggaaucguugcgauugaccuggaucccguggucuaugacgcuaaauuugaaaagcagcugggccagaucaugcuccuuauucuguguacgucucaaauccugcucaugcgcacaaccugggcccugugcgagagcauuacacuugcuaccgggccucugaccacacucugggagggauccccgggcaaauucuggaacacgaccaucgccgugucuauggccaauaucuuuagaggcagcuaccuggcuggggccggacuggcguucucccucaugaaaagccuuggcgggggacggcgcggcacaggggcccagggagaaacccugggcgagaaauggaagagacagcugaaccagcucuccaagucugaguucaauacauauaaacggagcggcauuauggagguggacagauccgaagcuaaggaggggcugaaacgcggagagaccacgaagcaugccguuucucggggcacagcuaaacuuagaugguuugucgaacgcaaccuggugaagcccgaggggaaggugaucgaucucggauguggcagagggggauggagcuacuauugcgccggccugaaaaaggucaccgaaguuaaaggcuacaccaaagggggaccuggccacgaggaacccauuccuauggcgacauacggguggaaucuggugaaacuccacuccggaaaggacguguucuuuauucccccugagaaaugugauacccuucugugcgacaucggcgagucuagcccgaaccccacaaucgaagaggggagaacgcugcgcguccucaagaugguggaaccuuggcugcggggaaaucaauucuguauuaagauccuuaaccccuauaugccuuccguuguggagacccuggagcagaugcagagaaaacauggcggcaugcucguccgcaauccccugagccggaacucuacacacgaaauguacuggguguccugcgggaccggaaauaucguuagcgccgugaacaugacaucuagaaugcugcucaaccgcuuuaccauggcucaucggaagccgacguaugagagagaugucgaccugggcaccgggacacgccacguggccguggaaccugaggucgcuaaucuugauauuaucggacagagaauugaaaacaucaaacacgagcauaaguccaccuggcacuacgacgaggauaaucccuauaaaacaugggccuaccauggcagcuaugaaguuaagcccucuggguccgcuagcuccauggugaacggaguggucaagcugcucaccaaaccuugggacgugauucccaugguuacacaaaucgccaugaccgauacgacaccuuucggccagcagcggguguuuaaggagaaagucgacacccgcaccccgaaggcgaaaagaggcacagcccaaaucauggaagugacggcucgguggcuguggggguuccuuagcagaaauaagaagccccggauuuguacccgcgaggaauuuacaagaaaaguucggucuaacgccgcuaucggagccguguucgucgacgagaaucaguggaacagcgccaaggaggcgguggaagaugagcgcuuuugggaccugguucacagagaacgggagcuccauaaacagggcaagugcgcuaccugcguguacaauaugauggggaaacgcgaaaagaagcugggagaguucggcaaagccaagggguccagagccauuugguacauguggcugggcgcucgguuucucgaguucgaagcccugggauucaugaacgaggaucacugguuuucucgcgaaaauagccuuuccggcgucgagggggagggacugcacaaacucggcuauauccugagagacauuucuaagaucccugggggaaacauguacgcugaugacacagccggcugggauacccggaucacagaagacgaucuucagaaugaggcgaaaauuaccgacaucauggaacccgagcaugcccugcucgcuaaggccauuuucaaacugacguaucaaaacaaggugguccgcgugcagagaccugcuaagaaugggaccguuauggaugugaucagccggcgcgaccagagaggcuccggacaggucggcacauacgggcugaacaccuuuacaaacauggaagcccaacucauucggcagauggagucugagggaaucuucagccccuccgaacuggagaccccgaaucuugcggaaagagcccuggauuggcucgagaaauauggcguggaacgccugaagcggauggcuaucagcggggacgacugugugguuaaaccuauugaugacagauuugccacggcucuuacagcccugaacgauaugggaaaggugcgcaaagacaucccccagugggagccuucuaagggcuggaaugauuggcagcaaguccccuucugcucccaccauuuucaccagcucauuaugaaggacgggcgggagaucgugguuccuuguagaaaccaggaugaacuggugggccgcgcucgggucagccagggagccggcuggucucugagagagaccgcgugccucgggaaauccuacgcccaaauguggcagcugauguauuuccaccgccgggaccuuagacuggcugccaaugccauuuguagcgcugugcccgucgauugggugccgacaucccgcaccacguggucuauccaugcccaccaucaguggaugaccacagaagacaugcucagcguuuggaaccggguguggauugaggaaaauccuuggauggaggauaagacccacaucuccagcugggaggacguccccuaccugggaaaaagagaagaccaauggugcggcucucuuaucgggcugacagcgcgggcuaccugggccacaaacauucagguggccaucaaucagguuagacgccucauuggaaacgagaauuaccuggauuauaugaccuccaugaagcgguuuaaaaacgaaagcgaccccgagggcgcucugugguga

SEQ ID NO: 18559 - RNA, 9879 nt, Artificial Sequence
  derived and/or modified CDS sequence (opt5) from DENV-1__FJ639682__SS-prME
agcgugacaaugcugcucaugcugaugcccacagcccuugcuuuccaccugacgacccggggaggggaaccucauaugaucguguccaagcaggaacggggaaaaucucuccuguuuaagacaagcgccggcguuaacaugugcacccuuauugcgauggaccugggggaacucugugaagauacaaugaccuacaaaugccccagaaucacagaagcugaacccgacgauguggacuguuggugcaaugccaccgauacgugggugaccuauggaacauguucccaaaccggcgagcaccggcgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagagaagacacuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaagcucaccguuguggucggagauguggccggcauucuggcucaggggaaaaagaugauccggccgcaacccauggaguacaaauauucuuggaaaagcuggggaaaggccaagauuaucggcgccgacgcucagaauaccacauucaucauugaugggccuaacacccccgaauguccugacgaucagagagcguggaauaucugggagguggaggacuacggauuuggcauuuucacgacaaacaucuggcugaaacuucgcgauuccuauacccaggucugcgaccaccggcucaugagcgccgcuauuaaagauucuaaggccguucacgccgacaugggcuacuggaucgaauccgagaaaaaugaaacauggaagcuggcuagagccagcuuuaucgaggugaagaccuguauuuggcccaaaucucauacacugugguccaacggggugcucgaaagcgagaugaucauuccgaagaucuauggaggcccuauuucucaacacaauuaccgccccggguacuucacccagacggcgggaccuuggcaucugggcaaacuugagcuggauuucgaccucugcgaagggaccacagucgugguugaugagcacugcggaaaccggggccccagccugagaaccacaaccgugacgggcaagaucauccacgaaugguguugccgguccuguacacugccuccccuucgcuuuagaggggaggacggaugcugguauggcauggagauucggccggucaaagaaaaggaggaaaaucucgugaaaagcaugguuucugcuggguccggagagguggacagcuucucccugggccugcucuguaucucuauuaugaucgaagaggucaugagaagccgcuggucccggaaaaugcugaugaccgggacacuugccguguuuuuccugcucauuaugggacagcugaccuggaacgaucugaucagacuuugcauuaugguuggcgccaaugcuucugaccgcaugggcauggggaccacauaccuggcccucauggcgacguuuaagaugagaccuauguucgcugugggacugcucuuucggcgccugaccagcagagagguccuucugcucacaaucggccugucccugguggccucuguggaacuucccaacagccuggaggaacucggggauggacuggccaugggcaucaugauucucaaacugcuuaccgacuuccaaucccaucagcugugggcuacacuccugagccugaccuuuaucaagacgacauucucucuucacuaugccuggaaaaccauggcuaugguccuguccauuguuagccucuuuccccugugucucucuaccacaucccagaagaccacauggcugccugugcuucuggggagccugggaugcaagccgcucacgauguuccugaucgccgagaauaaaauuuggggccggaagucuuggccccuuaacgaaggcaucauggcgguggggaucgucuccauucugcucagcucccugcucaaaaacgaugugccucuggccggaccccuuaucgcuggcgggaugcugauugccuguuacguucugagcggaucuagcgcugaccucucccuggagaaggccgccgaggugucuugggaagaggaagcugagcauagcggcgcgucccacaauauccuugucgaagugcaggaugacgggaccaugaaaauuaaggaugaggagcgcgacgauacacugaccauccuccugaaagccacacuccuggcuguuucuggaguguauccucuuagcauccccgccacccuguuugucugguacuucuggcaaaagaagaaacagagauccggcgugcugugggacacgccuucucccccggaagucgagcgggccgugcucgaugacggcauuuaucgcaucaugcagagagggcugcuuggacggagccagguuggcgugggggucuuccaagaaaacguguuucauaccauguggcacguuacacgcggagcugugcugauguaccagggcaagagacucgagccuuccugggccagcgucaaaaaggaccugauuucuuacgggggaggcuggcggcuccagggcuccuggaauaccggggaggaaguccaggugaucgcgguugagcccggcaagaacccuaagaauguccaaacagcucccggcaccuucaagacaccggaaggggaggugggagccauugcccuggauuuuaaaccuggcacgagcgggucucccaucgugaacagagaaggaaagauugucggccuuuauggcaauggggugguuaccacauccggaaccuacgugagcgcuaucgcccaggcgaaggcuucccaggagggcccucugcccgagaucgaagacgaggucuuccgcaagcggaaccugaccauuauggaucuccaccccgggucuggaaaaacaagacgcuaucugccugccaucgugcgggaagccauuaagagaaaacuucgcacgcugauccucgcuccgacccggguuguggccagcgagauggcugaagcccugaaaggcauucccaucagauaccaaacaaccgcggucaaguccgagcauacagggaaagagaucguggaccugaugugccacgccaccuuuacgaugcgccuccuuagcccuguucgggugcccaauuauaacaugauuaucauggaugaagcucauuucacagacccuucuuccauugccgcuagaggcuacaucagcacccgggucggaaugggcgaggccgccgcuauuuuuaugaccgcgacacccccugggucuguggaagccuucccgcagagcaaugcugugauccaggaugaggaacgcgacauccccgagagauccuggaacucuggauaugaguggauuaccgauuuuccuggcaagacagucugguucguucccagcaucaaauccgggaaugacauugccaacugucugcggaagaauggaaagcgcgugauccagcugucuagaaaaaccuuugauacggaauaccaaaagaccaagaacaacgacugggacuacguggucaccacagauauuagcgagaugggcgccaauuuccgggcugacagagugaucgauccucgccggugccucaagcccguuauucugaaagacgggccggaaagagugauccuugccggcccuaugcccgucaccguggcguccgcugcccagcgccggggaagaaucggccgcaaccacaauaaggagggggaucaguauauuuacaugggacagccccugaacaaugacgaggaucaugcccacuggacggaagcuaagaugcuccuggacaacaucaauaccccugagggcauuauccccgcccuguucgaaccugagcgggaaaagagcgcggccauugauggggaguauagacuccgcggagaggcuagaaagacauuuguugagcuuaugcggcgcggcgaccugccgguguggcugucuuacaaagucgccuccgagggguuccaauauagcgauagacgguggugcuuugacggcgaacgcaacaaucaggugcucgaggaaaacauggaugucgagaucuggaccaaggagggagaacgcaaaaagcugcggcccagauggcuugacgcucgcacauacuccgacccucuggcccuccgggaguucaaagaauuugcugccggcagacgcucugugagcggggaucugauccuggagauuggaaagcucccccagcaccuuacccagcgggcgcaaaaugcccuggacaaccugguuaugcuccauaauuccgaacagggcgggagagcuuaucggcacgccauggaggagcugccugauacaaucgaaacccuuaugcugcucgcucugauugccgugcugacgggaggcgugacacucuucuuucuuucuggccgcgggcugggaaagaccagcaucggccugcucugugucauggccuccagcguucugcuuuggauggcuucuguggagccccauuggauugcggccuccaucauccuggaguucuuucucauggugcugcugauuccggagccugacagacagcggacaccccaggauaaccaacucgcuuacgucgugaucgggcuucuguucaugauucugacaguugccgccaaugagaugggacuccuggaaaccaccaaaaaggaccuuggcaucgggcacguggcugucgagaaccaccaucacgccgcgaugcuggauguggaccuccauccugccagcgcuuggacgcuguacgccgucgcuaccacaauuaucacccccaugaugcgccacacaauugaaaacaccacggccaauaucucucugaccgcgaucgccaaccaggcugccauucucaugggacuugauaaaggcuggccuaucuccaagauggacauuggcgugccccugcuggcucucgggugcuauagccagguuaauccgcugacacuuaccgccgcugugcugaugcucgucgcccauuacgcgaucauuggaccuggccugcaagccaaagcuacaagagaggcccagaagcggaccgcugccgggaucaugaagaaccccacgguggauggaaucguugccauugaccuggaucccguggucuaugacgcgaaauuugaaaagcagcucggccagaucaugcuucugauucuguguacaucucaaauccuccugaugcgcaccacaugggcucuuugcgagagcauuacccuggccaccgggccucucacaacgcugugggagggauccccgggcaaauucuggaauaccacaaucgcugugucuauggccaacaucuuuagaggcagcuaccuggccggggcuggacucgccuucucccuuaugaaaagccugggcgggggacggcgcggcaccggggcgcagggagaaacacugggcgagaaauggaagagacagcucaaucagcuguccaagucugaguucaacaccuauaaacggagcggcauuauggagguggacagauccgaagccaaggaggggcuuaaacgcggagagacgacaaagcacgcuguuucucggggcaccgccaaacugagaugguuugucgaacgcaaucucgugaagcccgaggggaaggugaucgaucugggauguggcagagggggauggagcuacuauugcgcuggccugaaaaaggucaccgaaguuaaaggcuacacaaaagggggaccuggccacgaggaacccauuccuauggccaccuacggguggaaccucgugaaacuucauuccggaaaggacguguucuuuauucccccugagaaaugugauacacugcugugcgacaucggcgagucuagcccgaaucccacgaucgaagaggggagaacccuccgcguccugaagaugguggaaccuuggcuucggggaaaccaauucuguauuaagauccugaaucccuauaugccuuccguuguggagacacucgagcagaugcagagaaaacacggcggcaugcugguccgcaacccccugagcagaaauucuacccaugaaauguacuggguguccugcgggacaggaaacaucguuagcgcggugaauaugaccucuagaaugcuccugaaccgcuuuacgauggcccaccggaagccgaccuaugagagagaugucgaccuuggcacagggacccgccacguggcuguggaaccugaggucgccaaccuggauauuaucggacagagaauugaaaauaucaaacaugagcacaaguccacauggcauuacgacgaggauaaccccuauaaaaccugggcuuaccacggcagcuaugaaguuaagcccucuggguccgccagcuccauggugaauggaguggucaagcuccugacaaaaccuugggacgugauucccaugguuacccaaaucgcuaugacggauacaaccccuuucggccagcagcggguguuuaaggagaaagucgacacccgcacaccgaaggccaaaagaggcacggcgcaaaucauggaagugaccgcccgguggcuuuggggguuccugagcagaaacaagaagccccggauuuguacacgcgaggaauuuaccagaaaaguucggucuaaugcugccaucggagcuguguucgucgacgagaaccaguggaauagcgccaaggaggccguggaagaugagcgcuuuugggaccucguucauagagaacgggagcugcacaaacagggcaagugcgcgacaugcguguacaacaugauggggaaacgcgaaaagaagcugggagaguucggcaaagcuaagggguccagagccauuugguacauguggcucggcgcccgguuucuggaguucgaagcucuuggauucaugaaugaggaucacugguuuucucgcgaaaacagccuguccggcgucgagggggagggacuccauaaacugggcuauauccuuagagacauuucuaagaucccugggggaaauauguacgccgaugacaccgcuggcugggauacacggaucaccgaagacgaucugcagaacgaggccaaaauuacggacaucauggaacccgagcacgcgcuccuggccaaggcuauuuucaaacugaccuaucaaaauaaggugguccgcgugcagagaccugccaagaacgggacaguuauggaugugaucagccggcgcgaccagagaggcuccggacaggucggcaccuacgggcucaauacauuuaccaacauggaagcucaacugauucggcagauggagucugagggaaucuucagccccuccgaacuugagacgccgaaccuggccgaaagagcgcucgauuggcuggagaaauauggcguggaacgccuuaagcggauggccaucagcggggacgacugugugguuaaaccuauugaugacagauuugcuacagcccugaccgcucucaaugauaugggaaaggugcgcaaagacaucccccagugggagccuucuaagggcuggaacgauuggcagcaaguccccuucugcucccaucacuuucaccagcugauuaugaaggacgggcgggagaucgugguuccuuguagaaaucaggaugaacuggugggccgcgcccgggucagccagggagcuggcuggucucucagagagacagccugccuggggaaauccuacgcgcaaauguggcagcuuauguauuuccaucgccgggaccugagacucgccgcuaacgccauuuguagcgccgugcccgucgauugggugccgaccucccgcacgaccuggucuauccacgcucaucaccaguggaugacaaccgaagacaugcugagcguuuggaaucggguguggauugaggaaaacccuuggauggaggauaagacacauaucuccagcugggaggacguccccuaccuuggaaaaagagaagaccaauggugcggcucucugaucgggcucaccgcccgggcgacaugggcuaccaauauucagguggccaucaaccagguuagacgccugauuggaaaugagaacuaccuggauuauaugacguccaugaagcgguuuaaaaaugaaagcgaccccgagggcgcccucugguga

SEQ ID NO: 18560 - RNA, 9879 nt, Artificial Sequence
  derived and/or modified CDS sequence (opt5) from DENV-1__JQ287664__SS-prME
agcgugaccaugcugcucaugcugaugcccaccgcucuugcuuuccaccugacgaccagaggaggggaaccucauaugaucguguccaagcaggaacggggaaaaucucuccuguuuaagacaagcgccggcguuaacaugugcacccuuauugcgauggaccugggggaacucugugaagauacaaugaccuacaaaugcccgagaaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagcggguggaaacaugggcccugcgccaccccggcuucaccgucaucgcucuuuuucuggcccaugugauugggacaucuaucacccagaagggaaucauuuucauccuccugaugcuuguuaccccuagcauggcgaugagaugcgugggcauugggucccgggauuuugucgagggacugagcggcgccacauggguggacgugguccucgagcacgggucuuguguuacgaccauggcuaaggauaaacccacacuggacaucgaacugcucaagaccgaggugacaaacccugccgugcugcgcaaacuuugcauugaagcuaagaucuccaauaccacgacagauagcagauguccgacccaaggagaggccacccuggucgaagaacaggacgcgaacuucgugugccggcgcacauuuguugauagaggcuggggcaauggguguggacucuucggcaaagggucucugauuaccugcgccaaguuuaagugcgugacaaaacuugagggaaagaucguccaguacgaaaaccugaaauauuccgugaucguuacggugcacaccggcgaccagcaucaagucgggaaugagagcacagaacacggaaccacagcuaccauuacgccccaggccccuaccucugagauccagcucacagacuacggcgcucugacccuggauuguagcccccggacaggccucgacuucaacgaaauggugcugcuuaccaugaaggagaaaagcuggcugguccauaagcagugguuucucgaucugccucuucccuggacguccggggccucuacaagccaagagaccuggaaucgccaggaccugcucgugacauucaaaaccgcccacgcuaagaagcaggaaguugugguccugggaucccaagagggcgcgaugcacaccgcccugacaggggcuacggaaauucagaccagcggaacaaccacaaucuuugccggccaucucaaaugcagacugaagauggauaaacuuacccugaaggggaugucuuaugugauguguacgggcuccuucaaacucgagaaggaaguugccgagacacagcacggaaccgugcugguccagauuaaguacgagggcaccgacgcuccgugcaaaaucccuuucagcacacaagaugaaaagggggugacccagaacggacggcugaucacagccaaucccauugugacggacaaagagaagccuguuaacaucgaagcggagccgcccuuuggcgagucuuauauugucaucggggcuggagaaaaagcccuuaagcucagcugguucaagaaaggcuccucuauugggaagauguuugaggccaccgcuagaggcgcccgccggauggcuauccugggagauacagccugggacuucggcagcaucgggggaguguuuaccuccgugggcaaacugguccaucagauuuucgggacagcguacggagugcucuuuagcggcguuucuuggaccaugaagaucgggauuggcgugcugcuuacguggcugggacucaauuccagaagcaccucucuguccaugacauguaucgccgucggccuggugacccuuuaccucgggguuauggugcaggcugauagcggaugcgucauuaacuggaaaggccgcgaacugaaguguggguccggaaucuucgugacaaaugagguucacaccuggacagaacaauauaaguuucaggccgacucuccuaaacggcugagcgcugccauuggcaaggcgugggaggagggggugugcggcaucagauccgccacccgccucgaaaacaucauguggcggcagauuucuaacgagcugaaucauauccuucuggaaaacgacaugaaauucacggucguggugggagaugucguuggcauucucgcucaggggaagaaaaugaucagaccgcaacccauggagcacaaguacagcuggaaauccuggggaaaggccaagauuaucggcgcugacgugcagaauacaaccuuuaucauugaugggccuaacacccccgaauguccugacgaucagcgcgccuggaauaucugggagguggaggacuauggauucggcauuuuuacaaccaacaucuggcugaaacugcgggauagcuacacgcaggucugcgaccacagacuuaugucugccgcuauuaaggauuccaaagcggugcaugccgacaugggcuauuggaucgaaagcgagaagaaugaaacauggaaacucgcucgcgccucuuucaucgagguuaagaccuguauuuggcccaagucccacacacuguggagcaacggggugcuggaaucugagaugaucauuccgaaaaucuacggaggcccuauuagccaacauaauuaucggcccggguacuucacccagacagccggaccuuggcaccucggcaagcuggagcuugauuuugaccugugcgaagggaccacggucgugguugaugagcacugcggaaacagaggccccucccuccggaccacaaccgugacaggcaaaaucauccaugaaugguguugccgcagcuguacccugccuccccugagauucaagggggaggacggaugcugguacggcauggagauucggccggucaaagaaaaggaggaaaaucuugugaagucuaugguuuccgcugggagcggagagguggacuccuuuucucucggccugcuguguaucagcauuaugaucgaagaggucaugagaucccgcuggucucggaaaaugcucaugacggggacacuggccguguucuuucuucugauuaugggacagcucaccuggaacgaucugaucagacugugcauuauggugggcgcgaaugcuagcgaccgcaugggcauggggacaaccuaucuugcccugauggccaccuucaagaugagaccuauguuugcugucggacuccuguuccggcgccucacauccagagagguucugcuucugacgaucggccucucucugguggccagcguggaacugcccaacucccuugaggaacugggggauggacucgcgaugggcaucaugauucugaaacuccugaccgacuuucaaagcuaccagcuuugggcuacacugcucucucugaccuucaucaagacaaccuuuucccugcacuaugccuggaaaacgauggccaugguccuuagcauugugucucugcucccccugugucucuccacaaccagccagaagaccacauggcugccuguucuucuggggucucugggaugcaagccgcucaccauguucuuuaucgcugagaauaaaauuuggggccggaaguccuggccccugaacgaaggcaucauggccguggggaucgucagcauucuucuguccagccuccugaaaaacgaugugccucucgcuggaccccugaucgccggcgggaugcuuauugcguguuacguuaucucuggaagcuccgccgaccugucucuggagaaggcugccgaggugagcugggaagaggaagcugagcauuccggcgccucucacaauauucucgucgaagugcaggaugacgggacaaugaaaaucaaggaugaggagcgcgacgauacgcugaccauccuucugaaagccacacuccuggcugucagcggaguguauccucucuccauucccgcgacccuguucguuugguacuucuggcaaaagaagaaacagagaucuggcgugcuuugggacacaccuuccccucccgaagucgagcgggccgugcuggaugacggcaucuaucgcauuaugcagagagggcugcucggacggucccagguuggcgugggggucuuucaagaaaacguguuccauaccauguggcacgugacgcgcggagcuguucugauguaccagggcaagagacuugagcccagcugggccucugucaaaaaggaccugaucuccuacgggggaggcuggcggcuccagggcagcuggaauaccggggaggaaguccaggugauugccgucgagcccggcaagaauccuaagaaugugcaaacagcucccggcaccuuuaagacaccggaaggggagguuggagccaucgcgcuggauuucaaaccuggcaccucugggucccccauugugaacagagaaggaaagaucgucggccucuauggcaauggggugguuacaacgagcggaaccuacguguccgcuaucgcccaggccaaggcuucucaggagggcccucugcccgagauugaagacgaggucuuucgcaagcggaaccuuacaaucauggaucugcaccccgggagcggaaaaaccagaaaguaucugccugccauugugcgcgaagcgaucaagcggaaacucagaacccugauucuugcuccgacacgcguuguggccuccgagauggccgaagcucugaagggcaugcccauccgguaccaaacgaccgccgucaaaagcgagcauacagggagagagaucguggaccucaugugccacgcuaccuucacaaugcgccugcugucuccugugcggguccccaauuauaacaugauuaucauggaugaagcccauuuuaccgacccuuccagcauugcggccagaggcuacaucucuacgcggguuggaaugggcgaggcugccgcuauuuucaugacagccacacccccugggagcguggaagccuuuccgcaguccaaugcugugauccaggaugaggaacgcgacauccccgagagaucuuggaacagcggauaugaguggauuaccgauuucccuggcaagacagucugguuugugcccuccaucaaaucugggaaugacauugcgaacugucuccggaagaauggaaagcgcguuauccagcuuagcagaaaaaccuucgauacagaauaccaaaagaccaaaaacaacgacugggacuacguggucacgacagauauuuccgagaugggcgccaauuuccgggcugacagagugaucgauccucgccggugccugaagcccguuauucugaaagacgggccggaaagagugauccucgccggcccuaugcccgucaccguggccagcgcugcccagcgccggggaagaaucggccgcaaccacaauaaggagggggaucaguauauuuacaugggacagccccugaacaaugacgaggaucaugcgcacuggacagaagcuaagaugcuucuggacaacaucaauaccccugagggcauuauccccgcccucuuugaaccugagcgggaaaaaucugccgcuauugauggggaguauagacugcgcggagaggccagaaagacguucgucgaacugaugcggcgcggcgaccucccgguguggcuuuccuacaaaguugcgagcgagggguuucaauauuccgauagacgguggugcuucgacggcgaacgcaacaaucaggugcuggaggaaaacauggauguggagaucuggaccaaggagggagaacgcaagaaacugcggcccagauggcucgacgcccgcacauacucugacccucuggcccuucgggaguuuaaagaguucgccgcuggcagacgcagcaucuccggggaucugauucucgagaucggaaaacugccccagcaccugacccagcgggcccaaaaugcucucgacaaccuugucaugcugcauaauucugaacagggcgggagagccuaucggcacgcgauggaggagcugccugauacaauugaaacccucaugcugcuugcccugaucgcuguucucacaggaggcgugacccuguuuuuccugagcggccgcgggcucggaaagacguccauuggccuucugugugugauggccagcucugcucugcucuggauggccuccgucgagccccauuggaucgccgcuagcaucauucuggaauuuuuccuuauggugcugcucaucccggagccugacagacagcggacaccccaggauaaccaacuggcguacguugugauugggcugcucuuuaugauccuuaccgucgccgcuaaugagaugggacugcuggaaaccaccaaaaaggaccucggcauugggcacguggccgucgagaaccaccaucacgccaccaugcuggauguggaccuucauccugcuucugccuggacacuguacgcgguugccacgaccaucauuacacccaugaugcgccacaccaucgaaaacacaaccgcuaauaucucccucacggccauugcuaaccaggccgcgauccugaugggacuggauaaaggcuggccuauuagcaagauggacaucggcgugccccuccuugcccuggggugcuauucucaggucaauccgcugacccucacagcugccgugcugaugcuuguugcucauuacgccauuaucggaccuggccugcaagcuaaagccaccagagaggcgcagaagcggacagccgcugggaucaugaagaaccccaccguggauggaauugucgccaucgaccucgaucccgugguguaugacgcuaaauucgaaaagcagcugggccagauuaugcugcucauccuuuguacgagccaaauucugcugaugcgcacaaccugggcccucugcgaguccaucacacuggccaccgggccucuuaccacacugugggagggaucuccgggcaaauuuuggaauacgaccaucgcgguuagcauggcuaacauuuucagaggcuccuaccucgccggggcuggacuggccuucagccugaugaagucccucggcgggggacggcgcggcacaggggcccagggagaaacccuuggcgagaaauggaagagacagcugaaucagcugucuaagagcgaauuuaacacauauaaacgguccggcauccucgaggucgacagaucugaagcuaaggaggggcugcgccggggagagaccacgaaacacgccgugagcagaggcacagcgaaacuucgcugguucguggaacggaaucuggucaaacccgaggggaagguuauugaucucggauguggcagagggggaugguccuacuauugcgccggccugaagaaagugaccgaagugaagggcuacaccaaagggggaccuggccacgaggaacccaucccuauggcuacauacggguggaaccuggucaagcuccauucuggaaaagacguguuuuucauucccccugagaagugugauacccuucugugcgacaucggcgagagcuccccgaaucccacaauugaagaggggcgcacgcugcggguucucaaaaugguggaaccuuggcugagaggaaaccaauuuuguaucaagauccuuaaucccuauaugccuagcgucguggagacccuggagcagaugcagcgcaagcacggcggcaugcucguucggaacccccugucuagaaauuccacacaugaaauguacugggugagcugcgggaccggaaacauugucucugccgugaauaugacaucccgcaugcugcucaaccgguucaccauggcucacagaaaaccgacguaugagcgcgauguggaccugggcgccgggaccagacacgucgcgguugaaccugagguggccaaccuugauaucauuggacagcggaucgaaaauauuaagcaugagcacaaaagcacauggcauuacgacgaggauaaccccuauaagaccugggcuuaccacggcucuuaugaagugaaacccuccgggagcgccuccagcauggucaauggagugguuaagcugcucacaaagccuugggacgugauccccauggucacccaaaucgcuaugacagauaccacgccuuuuggccagcagcgcguguucaaagagaagguugacacaagaaccccgaaagccaagcggggcaccgcucaaauuauggaagugacagccagauggcuguggggguuucuuucucggaacaaaaagccccgcaucuguacgagagaggaguucacccggaagguccgcagcaaugcggccauuggagcuguguuuguugacgagaaccaguggaacuccgccaaagaggcuguggaagaugagagauucugggaccugguccaucgggaacgcgagcuccacaagcagggcaaaugcgccacaugcguguacaacaugauggggaagagagagaaaaagcugggagaguuuggcaaggccaaagggucucgggcgaucugguacauguggcugggcgcucgcuuccucgaguucgaagcccugggauuuaugaaugaggaucacugguucagcagagaaaacucccuuucuggcgucgagggggagggacugcauaagcucggcuauauucugcgggacaucagcaaaaucccugggggaaauauguacgccgaugacaccgcuggcugggauacacgcauuaccgaagacgaucuucagaacgaggccaagaucacagacauuauggaacccgagcacgcucugcucgccaccuccaucuuuaaacugacguaucaaaauaaggugguuagagugcagcggccugcgaaaaacgggaccgucauggaugugauuucucgcagagaccagcggggcagcggacaggugggcacauacgggcugaauaccuucacaaacauggaagcccaacucaucagacagauggaguccgagggaaucuuuagccccucugaacuggagaccccgaaccuugcugaacgcguucuggauuggcucgagaaguauggcguggaacggcugaagagaauggccauuuccggggacgacugugucgugaaaccuaucgaugaccgcuucgcuacggcccuuacagcgcugaaugauaugggaaagguucggaaagacauuccccagugggagccuagcaagggcuggaacgauuggcagcaagugcccuuuugcucucaucacuuccaccagcucaucaugaaagacgggagagagauugucgugccuugucgcaaucaggaugaacuggucggccgggccagagugucccagggagcuggcuggagccugcgcgagaccgccugccucgggaaguccuacgcucaaauguggcagcugauguauuuucaucggagagaccuucgccuggccgcuaacgccaucuguucugcgguucccuucgauugggugccgacaagccggaccacgugguccauucacgcccaucaccaguggaugaccacagaagacaugcucagcgucuggaauagaguguggaucgaggaaaacccuuggauggaggauaagacccauaucucuuccugggaggacguucccuaccugggaaaacgggaagaccaauggugcggcagccuuauugggcugacagcuagagccaccugggccacaaauauccagguggcuauuaaccagguccgccggcucaucggaaaugagaacuaccuggauuauaugaccucuaugaagagauuuaaaaaugaaagcgacacggagggcgcccugugguga

SEQ ID NO: 18561 - RNA, 9879 nt, Artificial Sequence
  derived and/or modified CDS sequence (opt5) from DENV-1__FJ639683__SS-prME
agcgugaccaugcugcucaugcugaugcccaccgcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccaccagcuucucuaugaccuguauugccgugggccugguuacacuguaccuuggggugaugguccaggcugauuccggaugcgugaucaacuggaaaggccgcgaacucaagugugggagcggaauuuuuguuaccaaugaggugcacacauggaccgaacaauauaaguuccaggccgacuccccuaaacggcugucugcggccaucggcaaggcuugggaggagggggucugcggcaucagaagcgccacgcgccuggaaaacauuauguggaaacagaucuccaacgagcucaaucauauucugcuugaaaacgacaugaaguuuacagugguugugggagaugucgcuggcauccuggcccaggggaaaaagaugauucggccgcaacccauggaguacaaauauucuuggaaaagcuggggaaaggccaagaucaucggcgcugacgugcagaauaccaccuucauuaucgaugggccuaacacacccgaauguccugacgaucagagagcguggaauauuugggagguggaggacuacggauuuggcaucuucaccacgaacauuuggcucaagcugcgcgauuccuauacacaggucugcgaccaccggcugaugagcgccgcuaucaaagauucuaaggccguucacgccgacaugggcuacuggaucgaauccgagaaaaaugaaaccuggaaacuugcuagagccagcuucauugaggugaagacauguaucuggcccaagucucauacccucugguccaacggggugcuggaaagcgagaugauuaucccgaagauuuauggaggcccuaucucucaacacaauuaccgccccggguacuuuacacagaccgcgggaccuuggcaucugggcaaacucgagcuggauuucgaccuuugcgaagggacgaccgucgugguugaugagcacugcggaaaccggggccccagccugagaacaaccacagugaccggcaagaucauucacgaaugguguugccgguccuguacgcucccuccccugcgcuuuagaggggaggacggaugcugguauggcauggagauccggccggucaaagaaaaggaggaaaaucuggucaagagccuuguuucugcuggguccggagagguggacagcuucucccucggccugcuguguauuucuaucaugauugaagaggucaugagaagccgcuggucccggaaaaugcucaugacagggacccuggccguguuucuucugcucaucaugggacagcugacauggaacgaucugauuagacuuugcaucaugguuggcgccaaugcuucugaccgcaugggcauggggaccaccuaccuggcccucauggcgacauucaagaugagaccuauguuugcugugggacuccuguuccggcgccugacgagcagagagguccuucugcucaccaucggccugucccugguggccucuguggaacuucccaacagccuggaggaacucggggauggacuggccaugggcauuaugauccucaaacugcuuacagacuuucaaucccaucagcugugggcuacccuccugagccugacauucauuaagaccacguuuucucuucacuaugccuggaaaacaauggcuaugguccuguccaucguuagccucuucccccugugucucucuaccaccucccagaagacaaccuggcugccugugcuucuggggagccugggaugcaagccgcucacaauguuucugauugccgagaauaaaaucuggggccggcgcucuuggccccuuaacgaaggcaucauggcgguggggauugucuccauccugcucagcucccugcucaagaacgaugugccucuggccggaccccuuauugcuggcgggaugcugaucgccuguuacguuauuagcggaucuagcgcugaccugucccucgagaaagccgccgaggugucuugggaagaggaagcugagcauagcggcgcgucccacaauauccuggucgaagugcaggaugacgggacgaugaagaucaaagaugaggagagagacgauacccuuacaauucugcucaaggccacccugcucgcuguuucuggaguguauccucugagcauccccgccacacuuuucgucugguacuucuggcagaagaagaagcagcgguccggcgugcugugggacaccccuucucccccggaagucgagcgcgccgugcuggaugacggcauuuauagaaucaugcagcgggggcuccugggacgcagccagguuggcgugggggucuuucaagaaaacguguuccauacgauguggcacguuaccagaggagcugugcuuauguaccagggcaaacggcuggagccuuccugggccagcgucaagaaagaccucauuucuuacgggggaggcuggagacugcagggcuccuggaauacaggggaggaagugcaagugaucgcgguugagcccggaaagaacccuaaaaauguccaaaccgcucccggcacauuuaagaccccggaaggggaggugggagccauugcccucgauuucaagccuggcacaagcgggucucccaucgugaaccgcgaaggaaaaaucgucggccuguauggcaauggggugguuacgaccuccggaacauacgugagcgcuauugcccaggcgaaggcuucccaggagggcccucuucccgagaucgaagacgaggucuuucggaaaagaaaccugaccauuauggaucugcaccccgggucuggaaagacccgccgguaucucccugccaucgugagagaagccauuaaacgcaagcugcggacacuuauccuggcuccgacgagaguuguggccagcgagauggcugaagcccucaagggcaugcccauccgcuaccaaaccacagcggucaaauccgagcauaccgggaaggagauuguggaccugaugugccacgccacauucaccaugcggcugcucagcccuguuagagugcccaauuauaacaugaucauuauggaugaagcucauuuuacggacccuucuuccaucgccgcucggggcuacauuagcacacgcgucggaaugggcgaggccgccgcuaucuucaugaccgcgacacccccugggucuguggaagccuuuccgcagagcaaugcugugauccaggaugaggaaagagacauucccgagcgguccuggaacucuggacacgaguggaucacagauuucccuggcaaaaccgucugguuuguucccagcauuaaguccgggaaugacaucgccaacugucuucgcaaaaauggaaagagagugauucagcugucucggaagacauucgauaccgaauaucagaaaacgaagaacaacgacugggacuacguggucacaaccgauaucagcgagaugggcgccaauuucagagcugaccgcgugauugauccucggagaugccugaaacccguuauccucaaggacgggccggaacgcgugauccuggccggcccuaugcccgucacaguggcguccgcugcccagcggagaggacgcauuggccggaaccauaauaaagagggggaucaguacaucuauaugggacagccccuuaacaaugacgaggaucacgcccacuggaccgaagcuaagaugcugcucgacaacauuaauacgccugagggcaucauucccgcccuguuugaaccugagagagaaaagagcgcggccaucgauggggaguaccgccugagaggagaggcucggaaaaccuucguugaacucaugcgcagaggcgaccuuccgguguggcugucuuauaaggucgccuccgagggguuucaauacagcgaucggcgcuggugcuucgacggcgaaagaaacaaucaggugcuggaggaaaacauggaugucgagaucuggacaaaagagggagaacggaagaaacucagaccccgcuggcuggacgcucggaccuauuccgacccucuugcccugagagaguuuaaggaguucgcugccggccgccggucugugagcggggaucucauucuggagaucggaaaacugccccagcaucucacacagagagcgcaaaaugcccuugacaaccugguuaugcugcacaauuccgaacagggcgggcgggcuuaccgccaugccauggaggagcucccugauaccauugaaacacugaugcuucuggcucucaucgccgugcugaccggaggcgugacgcuguuuuuccucucuggcagagggcuuggaaagacaagcauuggccugcugugugucauggccuccagcguucuccuguggauggcuucuguggagccccacuggaucgcggccuccaucauucuugaauuuuuccugauggugcuccugaucccggagccugaccggcagcgcacaccccaggauaaccaacuggcuuaugucgugauugggcuccuuuuuaugauccugaccguugccgccaaugagaugggacugcucgaaacaaccaagaaagaccugggcauugggcacguggcugucggaaaccaucaccaugccgcgaugcuugauguggaccugcacccugccagcgcuuggacacucuacgccgucgcuacgaccaucauuacacccaugaugagacauaccaucgagaacacaaccgccaauaucucucugacggcgauugccaaccaggcugccauccugaugggccucgauaagggcuggccuauuuccaaaauggacaucggggugccccuucuggcucugggaugcuacagccagguuaauccgcucacccugacagccgcugugcuuaugcuggucgcccacuaugcgauuaucggcccugggcuccaagccaaggcuacccgggaagcccagaaacgcacagcugccggaaucaugaagaaccccaccguggauggcauuguugccaucgaccuggaucccguggucuacgacgcgaaguucgagaaacagcuggggcagauuaugcuccuuauccuguguacgucucaaauucugcucaugagaacaaccugggcucugugcgaaagcaucacacuugccaccggaccucugaccacacucugggagggcuccccgggcaaguuuuggaauacgaccaucgcugugucuauggccaacauuuuccgggggagcuaucuggccggagcuggccuggccuucucccucaugaaaagccuugggggaggccgcagagggacaggagcgcagggcgagacccugggcgaaaaguggaaacggcagcugaaucagcucuccaagucugaguuuaacacauacaagagaagcgggaucauggaaguggaccgcuccgaggccaaagaaggacugaagcggggcgagaccacgaaacacgcuguuucuagagggacagccaaacuucgcugguucgucgagcggaaucuggugaaacccgaaggaaaggugauugaucucggcugugggagaggaggcuggagcuauuacugcgcuggccugaagaaagucaccgagguuaagggguauaccaaaggaggcccugggcaugaggaacccaucccuauggccacauacggauggaaccuggugaagcuccacuccggcaaagacguguuuuucgugcccccugaaaagugugauacccuucugugcgacauuggggagucuagcccgaaucccacaaucgaggaaggacgcacgcugcgggugcucaaaaugguugagccuuggcugagaggcaaccaauuuuguauuaagauccuuaaucccuacaugccuuccguggucgaaacccuggagcagaugcagcgcaagcauggcgggaugcucgugcggaacccccugagcagaaauucuacacacgagauguauuggguuuccugcggaaccggcaacaucgugagcgcggucaauaugacaucucgcaugcugcucaaccgguucaccauggcccacagaaaaccgacguacgaacgcgauguggaccugggggcuggaaccagacauguggccgucgagccugaaguugcuaaccuugauauuaucggccagcggauugagaauaucaagcacgaacauaaauccacauggcacuaugacgaggauaaccccuacaagaccugggccuaucaugggagcuacgaggugaaacccucuggauccgcuagcuccauggugaauggcgucgugaagcugcucacaaagccuugggacguuauucccauggugacccaaaucgccaugacagauaccacgccuuuuggccagcagcgcgucuucaaagaaaagguggacacaagaaccccgaaagcgaagcgggggaccgcccaaaucauggagguuacagcuaaauggcuguggggauuucuuagcagaaacaagaagccccggauuuguacgcgcgaagaguucaccagaaaagugcggucuaaugccgcuaucggcgccgucuuuguggacgaaaaccaguggaauagcgccaaggaggcgguugaggaugaacgcuucugggaccuggugcacagagagcgggaacuccacaaacaggggaagugcgcuacaugcgucuauaacaugaugggaaaacgcgagaagaagcugggcgaauuugggaaagccaagggcuccagagccauuugguacauguggcugggagcucgguuccucgaguucgaggcccugggcuuuaugaaugaagaucauugguucucucgcgagaacagccuuuccgggguggaaggagagggccugcacaaacucggguacauccugagagacauuucuaagaucccuggaggcaauauguaugcugaugacaccgccgggugggauacacggaucaccgaggacgaucuucagaacgaagcgcgcauuacagacaucauggagcccgaacaugcccugcucgcuaaaagcauuuuuaagcugaccuaccaaaauaaagucgugagaguucagcggccugccaagaacggcacggugauggaugucaucucccgcagagaccagcggggaucuggccagguggggaccuauggacugaauacauucaccaacauggaggcucaacucauuagacagauggaaagcgagggcaucuuuucccccagcgagcuggaaacaccgaaccuugccgagcgcgugcuggauuggcucgaaaaguacgggguugagcggcugaaaagaauggcgaucucuggagacgacuguguggucaagccuauugaugaccgcuucgccaccgcucuuacggcccugaaugauaugggcaaagugcggaaggacaucccccagugggaaccuuccaaaggguggaacgauuggcagcaaguucccuuuugcagccaccacuuccaucagcucauuaugaaggacggcagagagaucguggucccuugucgcaaucaggaugagcuggugggacgggcuagagucucucagggcgccggguggucccugcgcgaaacagcuugccucggaaagagcuaugcccaaauguggcagcugauguacuuucaccggagagaccuucgccuggcggccaacgcuauuuguuccgccgugcccguugauuggaucccgaccucucggacaaccuggagcauucaugcccaccaucaguggaugacgaccgaggacaugcucuccguguggaauagagucuggaucgaagagaacccuuggauggaagauaaaacacacaucagcucuuggggcgacgugcccuaucuggggaagcgggaggaccaauggugcggaucccuuauuggccugaccgcuagagccacaugggcgaccaauauccagguugcuauuaaccaggugcgccggcucaucgggaaugagaacuaccuggauuacaugacaagcaugaaaagauucaagaaugaaucugaccccgagggcgcccugugguga

SEQ ID NO: 18562 - RNA, 9879 nt, Artificial Sequence
  derived and/or modified CDS sequence (opt5) from DENV-1__FJ639684__SS-prME
uccgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucuccgaagcugaacccgacgauguggacuguuggugcaaugccacagauaccugggugacguauggaaccuguucucaaacaggcgagcacagacgggacaagcgcagcguugcccucgcuccucauguggggcugggacuggagaccagaacagaaaccuggauguccucugagggcgccuggaaacagauucagcggguugaaacgugggcucuccgccaccccggcuuuacagugaucgcccuguuccuugcgcaugccauugggaccagcaucacacagaagggaaucauuuuuauccugcucaugcuggucaccccuuccauggcuaugagaugcgugggcauugggagccgggauuucguugagggacuuucuggcgccaccuggguggacgucgugcuggagcacggguccugugugacaacgauggcuaaggauaaacccacccucgacaucgaacugcugaagacagaggucaccaacccugccguucuccgcaaacugugcauugaagcgaagaucagcaauacaaccacggauucuagauguccgacacaaggagaggccacccuuguggaagaacaagacgcuaacuuugugugccggcgcaccuucgucgauagaggcuggggcaauggguguggacuguuuggcaaagggucccucauuacaugcgccaaguucaagugcgugaccaaacuggagggaaagaucguucaguacgaaaaccuuaaauauagcgugaucgucacagugcacacgggcgaccagcaucaaguugggaaugagucuaccgaacacggaacaaccgcuacaauuacaccccaggccccuuccacggagauccagcugaccgacuacggcgcccucacacuggauuguagcccccggaccggccuggacuuuaacgaaauggugcuccugacaaugaaggagaaauccuggcuuguccauaagcagugguuccuggaucucccucugcccuggaccucuggggcuagcacgucccaagagacauggaaucgccaggaccuucuggugaccuuuaaaacagcgcacgccaagaagcaggaagucgugguucucggaagccaagagggcgcuaugcacaccgcccugaccggggccacagaaauucagacgucuggaaccacaaccaucuucgcuggccaucugaaaugcagacucaagauggauaaacugacacuuaaggggauguccuaugugauguguaccggcagcuucaaacuggagaaggaagucgccgagacgcagcacggaacagugcucguucagauuaaguacgagggcaccgacgcgccgugcaaaaucccuuuuucuacccaagaugaaaagggggugacacagaacggacggcugaucaccgcuaaucccauugucacagacaaagagaagccugugaacaucgaagccgagccgcccuucggcgagagcuauauugugaucggggccggagaaaaagcucugaaacuuuccugguuuaagaaaggcucuagcauugggaagauguucgaggccacggcuagaggcgcccgccggauggcgauccucggagauaccgccugggacuuuggcuccaucgggggaguuuucacaagcgucggcaaacuggugcaucagauuuuugggaccgcuuacggagugcuguucucuggcgucuccuggacaaugaagaucgggauuggcgugcuccugaccuggcuuggacugaauagcagaucuacgucccucagcaugaccuguaucgccguuggccuggugacacuguaccuuggggucauggugcaggcugauuccggaugcguuauuaacuggaaaggccgcgaacucaagugugggucuggaaucuuugugaccaaugagguccacacauggaccgaacaauauaaguuccaggccgacagcccuaaacggcuguccgcggccauuggcaaggcuugggaggagggggugugcggcaucagaucugccacacgccuggaaaacaucauguggaaacagauuagcaacgagcucaaucauauccugcuugaaaacgacaugaaguuuaccguuguggucggagauguggcuggcauucuggcccaggggaaaaagaugauccggccgcaacccauggaguacaaauauuccuggaaaagcuggggaaaggccaagauuaucggcgcugacgugcagaauacgacauucaucauugaugggccuaacacccccgaauguccugacgaucagagagcguggaauaucugggaggucgaggacuacggauuuggcauuuucaccacaaacaucuggcucaagcugcgcgauucuuauacccagguuugcgaccaccggcugauguccgccgcuauuaaagauagcaaggccgugcacgccgacaugggcuacuggaucgaaucugagaaaaaugaaacguggaaacuugcuagagccuccuucaucgaggugaagacauguauuuggcccaaaagccauacccucuggucuaacgggguccuggaaagcgagaugaucauuccgaagaucuauggaggcccuauuucccaacacaauuaccgccccggguacuuuacacagaccgcgggaccuuggcaucugggcaaacucgagcuggauuucgaccuuugcgaagggacaaccgugguuguggaugagcacugcggaaaccggggccccagccugagaacgaccacagucaccggcaagaucauccacgaaugguguugccggucuuguacacucccuccccugcgcuuuaaaggggaggacggaugcugguauggcauggagauuagaccggugaaggaaaaggaggaaaaucugguuaaauccauggugagcgcuggguccggagaggucgacucuuucagccuuggccuccuguguaucuccauuaugaucgaagaggugaugcggucuagauggagccgcaagaugcugaugaccgggacgcucgccgucuuuuuccugcuuauuaugggacagcugacauggaacgaucucauccggcugugcauuauggugggcgccaaugcuuccgacagaaugggcauggggaugaccuaccuggcccuuauggcgacauuuaaaaugcgcccuauguucgcugucggacugcucuuuagacggcugaccucucgcgaggugcuccugcuuaccaucggccugagccucguggccuccgucgaacugcccaacagccuggaggaacuuggggauggacuggccaugggcaucaugauucucaagcugcucacagacuuccaaucucaucagcugugggcuacgcuucugucccucaccuuuaucaaaacaaccuucagccugcacuaugccuggaagacaauggcuaugguucugucuauugugucccuuuuuccccugugucucagcaccacgucucagaagacaaccuggcugccugugcuccuggggucccuuggaugcaaaccgcugaccauguuccugaucgccgagaauaagauuuggggcagaaaaagcuggccccucaacgaaggcaucauggcggucgggaucguguccauucugcuuagcucucugcucaagaacgauguuccucuggccggaccccucaucgcuggcgggaugcugauugccuguuacgugaucagcggauccucugcugaccuuagccuggagaaagccgccgaggucuccugggaagaggaagcugagcauucuggcgcgagccacaauauucugguggaaguucaggaugacgggacaaugaagaucaaagaugaggagcgggacgauacccucacaauccugcuuaaggccacgcugcucgcuguguccggagucuauccucugucuauucccgccacccucuucgugugguacuuuuggcaaaagaaaaagcagcgcagcggcguccugugggacacaccuagcccucccgaaguggagagagccguucuugaugacggcaucuaucggauuaugcagcgcgggcugcugggaagaagccaggugggcgucgggguguuccaagaaaacguuuuucauaccauguggcacgugacacggggagcuguccucauguaccagggcaaacgccuggagcccucuugggccuccgugaagaaagaccuuaucagcuacgggggaggcuggagacugcagggcucuuggaauaccggggaggaagugcagguuauugcggucgagcccggaaagaacccuaagaaugugcaaacggcucccggcaccuucaaaacauccgaaggggaggugggagccaucgcccucgauuuuaagccgggcaccagcggguccccuauugucaaccgggaaggaaaaaucgugggccuguauggcaaugggguugugacaaccucuggaacauacgucagcgcuaucgcccaggcgaaggcuucccaggagggcccccucccugagauugaagacgagguguucagaaaacgcaaccugacgaucauggaucuucaccccgggagcggaaagacccggagauaucugcccgccauuguucgcgaagccaucaagcggaaacugagaacacucauucuggcuccuacccgcguggucgccucugagauggcugaagcccuuaagggcaugccgauccgguaccaaaccacagcggugaaauccgagcauacggggaaggagaucguugaccugaugugccacgccaccuuuacaaugagacuccugagccccgugcgcgucccuaauuauaacaugauuaucauggaugaagcucauuucaccgaccccucuagcauugccgcucggggcuacaucuccacaagagugggaaugggcgaggccgccgcuauuuuuaugaccgcgacgccucccgggucuguggaagccuucccucagagcaaugcugucauccaggaugaggaacgggacaucccggagcgcuccuggaacucuggauaugaguggauuacagauuuucccggcaaaaccguuugguucgugccuagcaucaaguccgggaaugacauugccaacugucugagaaagaauggaaaacgggugauccagcucagccgcaagaccuucgauacagaauaccagaagaccaagaacaacgacugggacuacgucgugacaaccgauauuucugagaugggcgccaauuuuagagcugaccggguuaucgaucccagacgcugccuuaaaccugugauucugaaggacgggcccgaacgggucauccuggccggcccgaugccugugacgguugcguccgcugcccagagacgcggacggaucggcagaaaccacaauaaggagggggaucaguauauuuacaugggacagccccucaacaaugacgaggaucaugcccacuggacagaagcuaaaaugcugcuugacaacaucaauacccccgagggcauuaucccugcccuguucgaacccgagcgcgaaaagagcgcggccauugauggggaguaucggcucagaggagaggcucgcaaaacauuuguggaacugaugagacggggcgaccugccugucuggcucuccuacaagguggccucugagggguuccaauauagcgaucgcagauggugcuuugacggcgaacggaacaaucagguccuugaggaaaacauggauguggagaucuggaccaaagagggagaacgcaagaaacugagaccgcgguggcuggacgcuagaacguacuccgacccccucgcccugcgcgaguucaaggaauuugcugccggccggagaucuguuagcggggaucuuauccuggagauuggaaagcucccucagcaccugacccagcgcgcgcaaaaugcccuggacaaccucgugaugcuucauaauuccgaacagggcgggcgggcuuauagacacgccauggaggagcugcccgauacaaucgaaacccugaugcuccuggcucuuauugccgugcugacaggaggcgucacccucuucuuucugagcggccgggggcugggaaaaacaucuaucggccuccuuuguguuauggccuccagcgugcugcuguggauggcuucuguggagccucauuggauugcggccuccaucauccucgaguucuuucugaugguccuucugauucccgagccggaccgccagagaaccccucaggauaaccaacucgcuuacgugguuaucgggcugcuguucaugauucucacgguggccgccaaugagaugggacuucuggaaacaaccaagaaagaccugggcaucgggcacgucgcuguggagaaccaccaucacgccgcgaugcucgaugucgaccugcaucccgccagcgcuuggacccuuuacgccguggcuacaaccauuaucacaccuaugaugcggcacacgauugaaaacaccacagccaauaucucucugaccgcgaucgccaaccaggcugccauucucaugggacuggauaagggcuggcccaucagcaaaauggacauuggcguuccucugcucgcucuugggugcuauucccaggugaauccccugacacugaccgccgcuguccucaugcugguggcccauuacgcgaucauuggaccgggccuucaagccaaggcuacgcgcgaggcccagaagagaaccgcugccgggaucaugaaaaacccuacaguugauggaaucguggccauugaccuggaucccgucguguaugacgcgaaguuugaaaaacagcucggccagaucaugcugcugauucucuguaccucucaaauccuucugaugcggacaaccugggcucugugcgagagcauuacgcucgccacagggccccugaccacacuuugggagggauccccuggcaaguucuggaauaccaccaucgcugugagcauggccaacaucuuccgcggcuccuaccuggccggggcuggacucgccuuuucucugaugaaaagccugggcgggggaagacggggcacaggggcgcagggagaaacgcucggcgagaaguggaagcgccagcuuaaucagcuguccaaaucugaguucaacaccuauaagagaagcggcauuauggagguugaccgguccgaagccaaagaggggcugaagagaggagagacaaccaaacacgcugucucucgcggcacagccaagcuccggugguuuguggaaagaaaucuggugaagccggaggggaaagucaucgaucuuggauguggccgcgggggauggagcuacuauugcgcuggccugaagaaaguuaccgaagugaagggcuacacgaaagggggacccggccacgaggaaccuauucccauggccacauacggguggaaccucgugaagcugcauuccggaaaagacgucuucuuugugccucccgagaagugugauacccugcucugcgacaucggcgagagcucuccuaauccgaccauugaagaggggcggacacuuagaguucugaagaugguggaacccuggcugcgcggaaaccaauucuguaucaaaauucucaauccuuauaugcccuccgucguggagacccuggagcagaugcagcggaagcacggcggcaugcuuguuagaaacccucugagccgcaauucuacacaugaaauguacuggguguccugcgggacgggaaacaucgucagcgcggugaauaugaccucucggaugcuccugaacagauuuacaauggcccaccgcaaacccaccuaugagcgggauguggaccugggcgcugggacaagacacgucgccguugaaccggagguggcuaaccucgauaucauuggacagcgcaucgaaaauauuaagcaugagcacaaauccaccuggcauuacgacgaggauaacccuuauaagacgugggccuaccacggcagcuaugaagugaagcccuccgggagcgcuucuagcauggucaauggagugguuaaacugcuuaccaagcccugggacgugaucccuauggucacacaaauugccaugaccgauacaacccccuucggccagcagagaguguuuaaagagaagguugacacacggaccccuaaagcgaagcgcggcacggcccaaaucauggaagugacagcuaaguggcuguggggguuccucuccagaaacaaaaagccgcggaucuguaccagagaggaauuuacccggaaaguccgcucuaaugccgcuauuggagccguguucguugacgagaaccaguggaauagcgccaaggaggcgguggaagaugagagauuuugggaccugguccaucgggaacgcgagcuucacaaacagggcaagugcgcuacaugcguguacaacaugauggggaagagagagaagaagcugggagaguucggcaaagccaaggggucccgggccaucugguacauguggcucggcgcucgcuuccuggaguuugaagcccugggauucaugaaugaggaucacugguuuucuagagaaaacagccucuccggcgucgagggggagggacugcauaaacuuggcuauauucugcgggacaucucuaagauuagcgggggaaauauguacgcugaugacacggccggcugggauacccgcaucacagaagacgaucuccagaacgaggcgaaaaucaccgacauuauggaacccgagcacgcccugcuugcuaaguccaucuucaagcugacauaucaaaauaaagugguuagagugcagcggccugccaagaacgggaccgucauggaugugauuagccgcagagaccagcggggcucuggacaggugggcacauacgggcucaauaccuuuacgaacauggaagcucaacugauccgccagauggaguccgagggaauuuucagccccucugaacuggagaccccuaaccucgccgaaagagcgcuggauuggcuugagaaacauggcguugaacggcugaagagaauggccaucuccggggacgacuguguggucaaacccaucgaugaccgcuuugcuacagcccucaccgcucugaaugauaugggaaaggugcggaaggacauuccgcagugggagccuagcaaaggcuggaacgauuggcagcaaguucccuucugcucccaccacuuucaucagcuuaucaugaaggacgggagagagauuguggucccuugucgcaaucaggaugaacuggugggccgggccagagucucucagggagcuggcuggagccuccgcgagacagccugccuggggaaauccuaugcgcaaauguggcagcugauguacuuccaccggagagaccuccgccuggccgcuaacgccaucuguagcgccgugcccguugauugggugccuaccucucggacgacaugguccauucaugcucaccaucaguggaugaccacagaagacaugcuuagcgucuggaauagaguguggaucgaggaaaaccccuggauggaggauaagacccacauuucuagcugggaggacguuccguaucugggaaaacgcgaagaccaauggugcggcucccucaucgggcugacggcccgggcgaccugggcuacaaauauccagguggccauuaaccaggucagacggcuuaucggaaaugagaacuaccuggauuacaugaccucuaugaagagauuuaagaaugaaagcgugccugagggcgcccucugguga

SEQ ID NO: 18563 - RNA, 9879 nt, Artificial Sequence
  derived and/or modified CDS sequence (opt5) from DENV-1__FJ639685__SS-prME
agcgugaccaugcugcugaugcugaugcccaccgcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccaccagcuucucuaugaccuguauugccgugggccugguuacacuguaccuuggggugaugguccaggcugauuccggaugcgugaucaacuggaaaggccgcgaacucaagugugggagcggaauuuuuguuaccaaugaggugcacacauggaccgaacaauauaaguuccaggccgacuccccuaaacggcugucugcggccaucggcaaggcuugggaggagggggucugcggcaucagaagcgccacgcgccuggaaaacauuauguggaaacagaucuccaacgagcucaaucauauucugcuugaaaacgacaugaaguuuacagugguugugggagaugucgcuggcauccuggcccaggggaaaaagaugauucggccgcaacccauggaguacaaauauucuuggaaaagcuggggaaaggccaagaucaucggcgcugacgugcagaauaccaccuucauuaucgaugggccuaacacacccgaauguccugacgaucagagagcguggaauauuugggagguggaggacuacggauuuggcaucuucaccacgaacauuuggcucaagcugcgcgauuccuauacacaggucugcgaccaccggcugaugagcgccgcuaucaaagauucuaaggccguucacgccgacaugggcuacuggaucgaauccgagaaaaaugaaaccuggaaacuugcuagagccagcuucauugaggugaagacauguaucuggcccaagucucauacccucugguccaacggggugcuggaaagcgagaugauuaucccgaagauuuauggaggcccuaucucucaacacaauuaccgccccggguacuuuacacagaccgcgggaccuuggcaucugggcaaacucgagcuggauuucgaccuuugcgaagggacgaccgucgugguugaugagcacugcggaaaccggggccccagccugagaacaaccacagugaccggcaagaucauucacgaaugguguugccgguccuguacgcucccuccccugcgcuuuagaggggaggacggaugcugguauggcauggagauccggccggucaaagaaaaggaggaaaaucuggucaagagcaugguuucugcuggguccggagagguggacagcuucucccuuggccuccuguguauuucuaucaugauugaagaggucaugagaagccgcuggucccggaaaaugcugaugacagggacccucgccguguuucugcuucugaucaugggacagcucacauggaacgaucugauuagacugugcaucaugguuggcgccaaugcuucugaccgcaugggcauggggaccaccuaccuugcccugauggcgacauucaagaugagaccuauguuugcugugggacuccuguuccggcgccucacgagcagagagguccugcuucugaccaucggccucucccugguggccucuguggaacugcccaacagccuugaggaacugggggauggacucgccaugggcauuaugauccugaaacuccugacagacuuucaaucccaucagcuuugggcuacccugcucagccugacauucauuaagaccacguuuucucugcacuaugccuggaaaacaauggcuaugguccuuuccaucguuagccuguucccccucugucugucuaccaccucccagaagacaaccuggcucccugugcugcuugggagccugggaugcaagccgcugacaauguuucucauugccgagaauaaaaucuggggccggcgcucuuggccccugaacgaaggcaucauggcgguggggauugucuccauccuucugagcucccuccugaagaacgaugugccucucgccggaccccugauugcuggcgggaugcuuaucgccuguuacguuauuagcggaucuagcgcugaccugucccuggagaaagccgccgaggugucuugggaagaggaagcugagcauagcggcgcgucccacaauauccucgucgaagugcaggaugacgggacgaugaagaucaaagaugaggagagagacgauacccugacaauucuucugaaggccacccuccuggcuguuucuggaguguauccucucagcauccccgccacacuguucgucugguacuucuggcagaaaaagaagcagcgguccggcgugcuuugggacaccccuucucccccggaagucgagcgcgccgugcuggaugacggcauuuauagaaucaugcagcgggggcugcucggacgcagccagguuggcgugggggucuuucaagaaaacguguuccauacgauguggcacguuaccagaggagcugugcugauguaccagggcaaacggcuugagccuuccugggccagcgucaagaaagaccugauuucuuacgggggaggcuggagacuccagggcuccuggaauacaggggaggaagugcaagugaucgcgguugagcccggaaagaacccuaaaaauguccaaaccgcucccggcacauuuaagaccccggaaggggaggugggagccauugcccuggauuucaagccuggcacaagcgggucucccaucgugaaccgcgaaggaaaaaucgucggccucuauggcaauggggugguuacgaccuccggaacauacgugagcgcuauugcccaggcgaaggcuucccaggagggcccucugcccgagaucgaagacgaggucuuucggaaaagaaaccuuaccauuauggaucugcaccccgggucuggaaagacccgccgguaucugccugccaucgugagagaagccauuaaacgcaagcuccggacacugauccuugcuccgacgagaguuguggccagcgagauggcugaagcccugaagggcaugcccauccgcuaccaaaccacagcggucaaauccgagcauaccgggaaggagauuguggaccucaugugccacgccacauucaccaugcggcugcugagcccuguuagagugcccaauuauaacaugaucauuauggaugaagcucauuuuacggacccuucuuccaucgccgcucggggcuacauuagcacacgcgucggaaugggcgaggccgccgcuaucuucaugaccgcgacacccccugggucuguggaagccuuuccgcagagcaaugcugugauccaggaugaggaaagagacauucccgagcgguccuggaacucuggauaugaguggaucacagauuucccuggcaaaaccgucugguuuguucccagcauuaaguccgggaaugacaucgccaacugucuccgcaaaaauggaaagagagugauucagcuuucucggaagacauucgauaccgaauaccagaaaacgaagaacaacgacugggacuacguggucacaaccgauaucagcgagaugggcgccaauuucagagcugaccgcgugauugauccucggagaugccugaaacccguuauccugaaggacgggccggaacgcgugauccucgccggcccuaugcccgucacaguggcguccgcugcccagcggagaggacgcauuggccggaaccacaauaaagagggggaucaguauaucuacaugggacagccccugaacaaugacgaggaucaugcccacuggaccgaagcuaagaugcuucuggacaacauuaauacgccugagggcaucauucccgcccucuuugaaccugagagagaaaagagcgcggccaucgauggggaguaucgccugagaggagaggcucggaaaaccuucguugaacugaugcgcagaggcgaccucccgguguggcuuucuuacaaggucgccuccgagggguuucaauauagcgaucggcgcuggugcuucgacggcgaaagaaacaaucaggugcuggaggaaaacauggaugucgagaucuggacaaaagagggagaacggaagaaacugagaccccgcuggcucgacgcucggaccuacuccgacccucuggcccuuagagaguuuaaggaguucgcugccggccgccggucugugagcggggaucugauucucgagaucggaaaacugccccagcaccugacacagagagcgcaaaaugcccucgacaaccuuguuaugcugcauaauuccgaacagggcgggcgggcuuaucgccacgccauggaggagcugccugauaccauugaaacacucaugcugcuugcucugaucgccgugcucaccggaggcgugacgcuguuuuuccugucuggcagagggcucggaaagacaagcauuggccuucugugugucauggccuccagcguucugcucuggauggcuucuguggagccccauuggaucgcggccuccaucauucuggaauuuuuccuuauggugcugcucaucccggagccugaccggcagcgcacaccccaggauaaccaacuggcuuacgucgugauugggcugcucuuuaugauccuuaccguugccgccaaugagaugggacugcuggaaacaaccaagaaagaccucggcauugggcacguggcugccggaaaccaccaucacgcggccaugcuggaugucgaccuucauccugcuagcgccuggacacuguacgcuguggccacgaccaucauuacacccaugaugagacacaccaucgagaacacaaccgcgaauaucucucucacggccauugcuaaccaggccgcuauccugaugggccuggauaagggcuggccuauuuccaaaauggacaucggggucccccuccuugcccugggaugcuauagccaggugaauccgcugacccucacagcugccguucugaugcuuguggcgcauuacgccauuaucggcccugggcugcaagcuaaggccacccgggaagcucagaaacgcacagccgccggaaucaugaagaaccccaccgucgauggcauuguggcgaucgaccucgaucccguuguguaugacgcuaaguucgagaaacagcuggggcagauuaugcugcucauccuuuguacgucucaaauucugcugaugagaacaaccugggcccucugcgaaagcaucacacuggcuaccggaccucuuaccacacugugggagggcuccccgggcaaguuuuggaauacgaccaucgccgucucuauggccaacauuuuccgggggagcuaccucgcuggagccggccuggcguucuccgugaugaaaagccucgggggaggccgcagagggacaggagcccagggcgagacccucggcgaaaaguggaaacggcagcuuaaucagcuguccaagucugaguuuaacacauauaagagaagcgggaucauggaaguggaccgcuccgaggcuaaagaaggacugaagcggggcgagaccacgaaacacgccguuucuagagggacagcuaagcuccgcugguucgucgagcggaaucuggugaaacccgaaggaaaggugauugaucuuggcugugggagaggaggcuggagcuacuauugcgccggccugaagaaagucaccgagguuaagggguacaccaaaggaggcccugggcacgaggaacccaucccuauggcgacauacggauggaaccucgugaagcugcauuccggcaaagacguguuuuucgugcccccugaaaagugugauacccugcucugcgacauuggggagucuagcccgaaucccacaaucgaggaaggacgcacgcuucgggugcugaaaaugguugagccuuggcugagaggcaaccaauuuuguauuaagauccucaaucccuauaugccuuccguggucgaaacccuggagcagaugcagcgcaagcacggcgggaugcuugugcggaacccccugagcagaaauucuacacaugagauguacuggguuuccugcggaaccggcaacaucgugagcgccgucaauaugacaucucgcaugcuccugaaccgguucaccauggcucacagaaaaccgacguaugaacgcgauguggaccugggggccggaaccagacacguggcugucgagccugaaguugccaaccucgauauuaucggccagcggauugagaauaucaagcaugaacacaaauccacauggcauuacgacgaggauaaccccuauaagaccugggcuuaccacgggagcuaugaggugaaacccucuggauccgccagcuccauggugaauggcgucgugaagcugcuuacaaagccuugggacguuauucccauggugacccaaaucgcgaugacagauaccacgccuuuuggccagcagcgcgucuucaaagaaaagguggacacaagaaccccgaaagccaagcgggggaccgcucaaaucauggagguuacagccaaauggcuguggggauuucucagcagaaacaagaagccccggauuuguacgcgcgaagaguucaccagaaaagugcggucuaaugcugccaucggcgccgucuuuguggacgaaaaccaguggaauagcgcgaaggaggcuguugaggaugaacgcuucugggaccuggugcauagagagcgggaacuucacaaacaggggaagugcgccacaugcgucuacaacaugaugggaaaacgcgagaagaagcugggcgaauuugggaaagccaagggcuccagagcuauuugguacauguggcucggagcccgguuccuggaguucgaggcucugggcuuuaugaaugaagaucacugguucucucgcgagaacagccucuccgggguggaaggagagggccugcauaaacuuggguauauccugagagacauuucuaagaucccuggaggcaauauguacgccgaugacaccgcggggugggauacacggaucaccgaggacgaucuccagaacgaagcccgcauuacagacaucauggagcccgaacacgcucugcuugccaaaagcauuuuuaagcugaccuaucaaaauaaagucgugagaguucagcggccugcuaagaacggcacggugauggaugucaucucccgcagagaccagcggggaucuggccagguggggaccuacggacucaauacauucaccaacauggaggcccaacugauuagacagauggaaagcgagggcaucuuuucccccagcgagcuggaaacaccgauccucgcggagcgcgugcuggauuggcuugaaaaguaugggguugagcggcugaaaagaauggccauuucuggagacgacuguguggucaagccuaucgaugaccgcuucgcuaccgcccucacggcucugaacgauaugggcaaagugcggaaggacauuccccagugggaaccuuccaaaggguggaaugauuggcagcaaguucccuuuugcagccaucacuuccaccagcuuaucaugaaggacggcagagagauuguggucccuugucgcaaccaggaugagcuggugggacgggccagagucucucagggcgcuggguggucccuccgcgaaacagccugccugggaaagagcuacgcgcaaauguggcagcugauguauuuucaucggagagaccuccgccuggccgcuaaugccaucuguuccgccgugcccguugauuggauuccgaccucucggacaaccuggagcauccacgcucaucaccaguggaugacgaccgaggacaugcuuuccguguggaacagagucuggaucgaagagaauccuuggauggaagauaaaacacauauuagcucuuggggcgacgugcccuaccuggggaagcgggaggaccaauggugcggaucccucaucggccugaccgccagagcgacaugggcuaccaacauucagguugccaucaaucaggugcgccggcuuauugggaacgagaauuaccuggauuauaugacaagcaugaaaagauucaagaacgaaucugaccccgagggcgcccucugguga

SEQ ID NO: 18564 - RNA, 9879 nt, Artificial Sequence
  derived and/or modified CDS sequence (opt5) from DENV-1__FJ639686__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagagcaggacgcuaacuucgugugccggcgcacauuuguggauagaggcuggggcaauggguguggacucuucggcaaagggucucugaucaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagauccgguacgagggcacagacgcgccgugcaagaucccuuucuccacccaagaugaaagagggguuacacagaacggacgccugauuacggcuaaucccaucgugaccgacaaagagaagccugucaacauugaagccgagccccccuuuggcgagagcuauaucgugauuggggccggagaaaaagcucuuaagcucucuugguucaaaaagggcagcuccaucgggaagauguuugaggccacagcucggggcgccagacgcauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucucgguccacaagcuucucuaugaccuguauugccgugggccugguuacacuguaccuuggggugaugguccaggcugauuccggaugcgugaucaacuggaaaggcagagaacucaagugugggagcggaauuuuuguuaccaaugaggugcacacauggaccgaacaauauaaauuccaggccgacuccccuaagcgccugucugcggccaucggcaaggcuugggaggagggggucugcggcauccggagcgccacgagacuggaaaacauuauguggaaacagaucuccaacgagcucaaucauauucugcuugaaaacgacaugaaguuuacagugguugugggagaugucgcuggcauccuggcccaggggaaaaagaugauucgcccgcaacccauggaguacaaauauucuuggcggagcuggggaaaggccaaaaucaucggcgcugacgugcagaauaccaccuucauuaucgaugggccuaacacacccgaauguccugacgaucagagagcguggaauauuugggagguggaggacuacggauuuggcaucuucaccacgaacauuuggcucaagcugcgcgauuccuauacacaggucugcgaccaccggcugaugagcgccgcuaucaaggauucuaaagccguucacgccgacaugggcuacuggaucgaauccgagaagaaugaaaccuggaaacuugcuagagccagcuucauugaggugaagacauguaucuggcccaaaucucauacccucugguccaacggggugcuggaaagcgagaugauuaucccgaagauuuauggaggcccuaucucucaacacaauuaccggcccggguacuuuacacagaccgcgggaccuuggcaucugggcaagcucgagcuggauuucgaccuuugcgaagggacgaccgucgugguugaugagcacugcggaaaccgcggccccagccugagaacaaccacagugaccggcaaaaucauucacgaaugguguugccgguccuguacgcucccuccccugagauuucgcggggaggacggaugcugguauggcauggagauccggccggucaaggaaaaagaggaaaaucuggugaagagcaugguuucugcuggguccggagagguggacagcuucucccuuggccuccuguguauuucuaucaugauugaagaggucaugagaagccgcugguccagaaaaaugcugaugacagggacccucgccguguuucugcuucugaucaugggacagcucacauggaacgaucugauucggcugugcaucaugguuggcgccaaugcuucugaccgcaugggcauggggaccaccuaccuugcccugauggcgacauucaagaugagaccuauguuugcugugggacuccuguuccggcgccucacgagcagagagguccugcuucugaccaucggccucucccugguggccucuguggaacugcccaacagccuugaggaacugggggauggacucgccaugggcauuaugauccugaagcuccugacagacuuucaaucccaucagcuuugggcuacccugcucagccugacauucauuaaaaccacguuuucucugcacuaugccuggaagacaauggcuaugguccuuuccaucguuagccuguucccccucugucugucuaccaccucccagaaaacaaccuggcucccugugcugcuugggagccugggaugcaagccgcugacaauguuucucauugccgagaauaaaaucuggggccggcgcucuuggccccugaacgaaggcaucauggcgguggggauugucuccauccuucugagcucccuccugaagaacgaugugccucucgccggaccccugauugcuggcgggaugcuuaucgccuguuacguuauuagcggaucuagcgcugaccugucccuggagaaggccgccgaggugucuugggaagaggaagcugagcauagcggcgcgucccacaauauccucgucgaagugcaggaugacgggacgaugaaaaucaaggaugaggagagagacgauacccugacaauucuucugaaagccacccuccuggcuguuucuggaguguauccucucagcauccccgccacacuguucgucugguacuucuggcaaaagaaaaagcagcgguccggcgugcuuugggacaccccuucucccccggaagucgagcgcgccgugcuggaugacggcauuuauagaaucaugcagcgggggcugcucggaagaagccagguuggcgugggggucuuucaagaaaacguguuccauacgauguggcacguuacccgcggagcugugcugauguaccagggcaaacggcuugagccuuccugggccagcgucaagaaggaccugauuucuuacgggggaggcuggagacuccagggcuccuggaauacaggggaggaagugcaggugaucgcgguugagcccggaaaaaacccuaagaauguccaaaccgcucccggcacauuuaaaaccccggaaggggaggugggagccauugcccuggauuucaagccuggcacaagcgggucucccaucgugaaccgcgaaggaaaaaucgucggccucuauggcaauggggugguuacgaccuccggaacauacgugagcgcuauugcccaggcgaaggcuucccaggagggcccucugcccgagaucgaagacgaggucuuucggaagagaaaccuuaccauuauggaucugcaccccgggucuggaaaaacccgccgguaucugccugccaucgugagagaagccauuaagcgcaaacuccggacacugauccuugcuccgacgagaguuguggccagcgagauggcugaagcccugaagggcaugcccauccgguaccaaaccacagcggucaaauccgagcauaccgggaaggagauuguggaccucaugugccacgccacauucaccaugcgccugcugagcccuguuagagugcccaauuauaacaugaucauuauggaugaagcucauuuuacggacccuucuuccaucgccgcucggggcuacauuagcacacgcgucggaaugggcgaggccgccgcuaucuucaugaccgcgacccccccugggucuguggaagccuuuccgcagagcaaugcugugauccaggaugaggaaagagacauucccgagcgguccuggaacucuggauaugaguggaucacagauuucccuggcaagaccgucugguuuguucccagcauuaaauccgggaaugacaucgccaacugucucagaaagaauggaaaacgcgugauucagcuuucucggaagacauucgauaccgaauaccaaaaaacgaagaacaacgacugggacuacguggucacaaccgauaucagcgagaugggcgccaauuucagagcugaccgcgugauugauccucggagaugccugaagcccguuauccugaaagacgggccggaacgcgugauccucgccggcccuaugcccgucacaguggcguccgcugcccagcggagaggacgcauuggcagaaaccacaauaaggagggggaucaguauaucuacaugggacagccccugaacaaugacgaggaucaugcccacuggaccgaagcuaaaaugcuucuggacaacauuaauacgccugagggcaucauucccgcccucuuugaaccugagcgggaaaagagcgcggccaucgauggggaguaucgccugagaggagaggcucggaaaaccuucguugaacugaugcgcagaggcgaccucccgguguggcuuucuuacaaggucgccuccgagggguuucaauauagcgaucggagauggugcuucgacggcgaacgcaacaaucaggugcuggaggaaaacauggaugucgagaucuggacaaaggagggagaacggaaaaagcugagaccccgcuggcucgacgcucggaccuacuccgacccucuggcccuuagagaguuuaaagaauucgcugccggccggcgcucugugagcggggaucugauucucgagaucggaaagcugccccagcaccugacacagagagcgcaaaaugcccucgacaaccuuguuaugcugcauaauuccgaacagggcgggcgggcuuaucgccacgccauggaggagcugccugauaccauugaaacacucaugcugcuugcucugaucgccgugcucaccggaggcgugacgcuguuuuuccugucuggcagagggcucggaaaaacaagcauuggccuucugugugucauggccuccagcguucugcucuggauggcuucuguggagccccauuggaucgcggccuccaucauucuggaauuuuuccuuauggugcugcucaucccggagccugaccggcagcgcaccccccaggauaaccaacuggcuuacgucgugauugggcugcucuuuaugauccuuaccguugccgccaaugagaugggacugcuggaaacaaccaagaaagaccucggcauugggcacguggcugucggaaaccaccaucacgccgcgaugcuggauguggaccuucauccugccagcgcuuggacacuguacgccgucgcuacgaccaucauuacacccaugaugagacacaccaucgagaacacaaccgccaauaucucucucacggcgauugccaaccaggcugccauccugaugggccuggauaagggcuggccuauuuccaagauggacaucggggugccccuccuugcucugggaugcuauagccagguuaauccgcugacccucacagccgcugugcugaugcuugucgcccauuacgcgauuaucggcccugggcugcaagccaaagcuacccgggaagcccagaagcgcacagcugccggaaucaugaaaaaccccaccguggauggcauuguugccaucgaccucgaucccguggucuaugacgcgaaguucgagaaacagcuggggcagauuaugcugcucauccuuuguacgucucaaauucugcugaugagaacaaccugggcucucugcgaaagcaucacacuggccaccggaccucuuaccacacugugggagggcuccccgggcaaguuuuggaauacgaccaucgcugugucuauggccaacauuuuccgggggagcuaccucgccggagcuggccuggccuucucccugaugaagagccucgggggaggcagacgcgggacaggagcgcagggcgagacccuuggcgaaaaauggaagcggcagcugaaucagcuguccaaaucugaguuuaacacauauaagagaagcgggaucauggaaguggaccgcuccgaggccaaagaaggacucaagcggggcgagauuaccaagcacgcuguuucuagagggacggccaaacugcgcugguucgucgagcggaaucuugugaagcccgaaggaaaagugaucgaucugggcugugggagaggaggcuggagcuacuauugcgcuggccucaagaaagucacagagguuaagggguacaccaagggaggcccugggcacgaagagcccauuccuauggccaccuacggauggaaccuggugaaacugcauuccggcaaggacguguuuuucguccccccugaaaaaugugauacacuccuuugcgacaucggggagucuagcccgaaucccaccauugaggaaggacgcacacugcgggugcugaagaugguugagccuuggcucagaggcaaccaauuuuguaucaaaauccugaaucccuauaugccuuccguggucgaaacgcuugagcagaugcagcgcaagcacggcgggaugcuggugcggaacccccucagcagaaauucuacccaugagauguacuggguuuccugcggaacaggcaacauugugagcgcggucaauaugaccucucgcaugcugcugaacagauucacaauggcccaccggaaaccgaccuaugaacgcgauguggaccucggggcuggaacgagacacguggccgucgagccugaaguugcuaaccuggauaucauuggccagcggaucgagaauauuaagcaugaacacaaguccaccuggcauuacgacgaggauaaccccuauaaaacaugggccuaccacgggagcuaugaggugaagcccucuggauccgcuagcuccauggugaauggcgucgugaaacuucugaccaagccuugggacguuauccccauggugacacaaaucgccaugaccgauacaaccccuuuuggccagcagagagucuucaaagaaaagguggacacgcggacaccgaaggcgaaacgcgggaccgcccaaauuauggagguuaccgcuaaguggcucuggggauuucugagcagaaacaaaaagccccggaucuguacacgcgaagaguucacgagaaaagugcggucuaaugccgcuauuggcgccgucuuuguggacgaaaaccaguggaauagcgccaaggaggcgguugaggaugaacgcuucugggaccuugugcauagagagcgggaacugcacaagcaggggaaaugcgcuaccugcgucuacaacaugaugggaaagcgcgagaaaaagcucggcgaauuugggaaagccaagggcuccagagccaucugguacauguggcugggagcucgguuccuggaguucgaggcccucggcuuuaugaaugaagaucacugguucucucgcgagaacagccuguccgggguggaaggagagggccuucauaagcugggguauauucucagagacaucucuaaaaucccuggaggcaauauguacgcugaugacacagccgggugggauacccggauuacagaggacgaucugcagaacgaagcgcgcaucaccgacauuauggagcccgaacacgcccuucuggcuaagagcaucuuuaaacucacauaucaaaauaaggucgugagaguucagcggccugccaaaaacggcaccgugauggaugucauuuccagacgcgaccagcggggaucuggccagguggggacguacggacugaauaccuucacaaacauggaggcucaacugaucagacagauggaaagcgagggcaucuuuucccccagcgagcucgaaaccccgaaccuggccgagcgcgugcuugauuggcuggaaaaguaugggguugagcggcucaaaagaauggcgauuucuggagacgacuguguggucaagccuaucgaugaccgcuucgccacagcucugaccgcccuuaaugauaugggcaaggugcggaaagacauuccccagugggaaccuuccaagggguggaacgauuggcagcaaguucccuuuugcagccaucacuuccaccagcugaucaugaaagacggcagagagauuguggucccuugucgcaaucaggaugagcucgugggacgggcuagagucucucagggcgccggguggucccugcgcgaaacggcuugccugggaaagagcuacgcccaaauguggcagcucauguauuuucaucggagagaccugcggcuugcggccaacgcuaucuguuccgccgugcccguugauuggauuccgacaucuagaaccacauggagcauccacgcccaucaccaguggaugaccacggaggacaugcuguccguguggaaucgcgucuggaucgaagagaacccuuggauggaagauaaaacccauauuagcucuuggggcgacgugcccuaccucgggaagcgggaggaccaauggugcggaucccugaucggccuuacagcuagagccaccugggcgacaaauauucagguugcuaucaaccaggugcgcagacugauugggaaugagaacuaccucgauuauaugaccagcaugaagcgguucaaaaaugaaucugaccccgagggcgcccugugguga

SEQ ID NO: 18565 - RNA, 9879 nt, Artificial Sequence
  derived and/or modified CDS sequence (opt5) from DENV-1__FJ639687__SS-prME
uccgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucuccgaagcugaacccgacgauguggacuguuggugcaaugccacagauaccugggugacguauggaaccuguucucaaacaggcgagcacagacgggacaagcgcagcguugcccucgcuccucauguggggcugggacuggagaccagaacagaaaccuggauguccucugagggcgccuggaaacagauucagcggguugaaacgugggcucuccgccaccccggcuuuacagugaucgcccuguuccuugcgcaugccauugggaccagcaucacacagaagggaaucauuuuuauccugcucaugcuggucaccccuuccauggcuaugagaugcgugggcauugggagccgggauuucguugagggacuuucuggcgccaccuggguggacgucgugcuggagcacggguccugugugacaacgauggcuaaggauaaacccacccucgacaucgaacugcugaagacagaggucaccaacccugccguucuccgcaaacugugcauugaagcgaagaucagcaauacaaccacggauucuagauguccgacacaaggagaggccacccuuguggaagaacaagacgcuaacuuugugugccggcgcaccuucgucgauagaggcuggggcaauggguguggacuguuuggcaaagggucccucauuacaugcgccaaguucaagugcgugaccaaacuggagggaaagaucguucaguacgaaaaccuuaaauauagcgugaucgucacagugcacacgggcgaccagcaucaaguugggaaugagucuaccgaacacggaacaaccgcuacaauuacaccccaggccccuuccacggagauccagcugaccgacuacggcgcccucacacuggauuguagcccccggaccggccuggacuuuaacgaaauggugcuccugacaaugaaggagaaauccuggcuuguccauaagcagugguuccuggaucucccucugcccuggaccucuggggcuagcacgucccaagagacauggaaucgccaggaccuucuggugaccuuuaaaacagcgcacgccaagaagcaggaagucgugguucucggaagccaagagggcgcuaugcacaccgcccugaccggggccacagaaauucagacgucuggaaccacaaccaucuucgcuggccaucugaaaugcagacucaagauggauaaacugacacuuaaggggauguccuaugugauguguaccggcagcuucaaacuggagaaggaagucgccgagacgcagcacggaacagugcucguucagauuaaguacgagggcaccgacgcgccgugcaaaaucccuuuuucuacccaagaugaaaagggggugacacagaacggacggcugaucaccgcuaaucccauugucacagacaaagagaagccugugaacaucgaagccgagccgcccuucggcgagagcuauauugugaucggggccggagaaaaagcucugaaacuuuccugguuuaagaaaggcucuagcauugggaagauguucgaggccacggcuagaggcgcccgccggauggcgauccucggagauaccgccugggacuuuggcuccaucgggggaguuuucacaagcgucggcaaacuggugcaucagauuuuugggaccgcuuacggagugcuguucucuggcgucuccuggacaaugaagaucgggauuggcgugcuccugaccuggcuuggacugaauagcagaucuacgucccucagcaugaccuguaucgccguuggccuggugacacuguaccuuggggucauggugcaggcugauuccggaugcguuauuaacuggaaaggccgcgaacucaagugugggucuggaaucuuugugaccaaugagguccacacauggaccgaacaauauaaguuccaggccgacagcccuaaacggcuguccgcggccauuggcaaggcuugggaggagggggugugcggcaucagaucugccacacgccuggaaaacaucauguggaaacagauuagcaacgagcucaaucauauccugcuugaaaacgacaugaaguuuaccguuguggucggagauguggcuggcauucuggcccaggggaaaaagaugauccggccgcaacccauggaguacaaauauuccuggaaaagcuggggaaaggccaagauuaucggcgcugacgugcagaauacgacauucaucauugaugggccuaacacccccgaauguccugacgaucagagagcguggaauaucugggaggucgaggacuacggauuuggcauuuucaccacaaacaucuggcucaagcugcgcgauucuuauacccagguuugcgaccaccggcugauguccgccgcuauuaaagauagcaaggccgugcacgccgacaugggcuacuggaucgaaucugagaaaaaugaaacguggaaacuugcuagagccuccuucaucgaggugaagacauguauuuggcccaaaagccauacccucuggucuaacgggguccuggaaagcgagaugaucauuccgaagaucuauggaggcccuauuucccaacacaauuaccgccccggguacuuuacacagaccgcgggaccuuggcaucugggcaaacucgagcuggauuucgaccuuugcgaagggacaaccgugguuguggaugagcacugcggaaaccggggccccagccugagaacgaccacagucaccggcaagaucauccacgaaugguguugccggucuuguacacucccuccccugcgcuuuaaaggggaggacggaugcugguauggcauggagauuagaccggugaaggaaaaggaggaaaaucugguuaaauccauggugagcgcuggguccggagaggucgacucuuucagccuuggccuccuguguaucuccauuaugaucgaagaggugaugcggucuagauggagccgcaagaugcugaugaccgggacgcucgccgucuuuuuccugcuuauuaugggacagcugacauggaacgaucucauccggcugugcauuauggugggcgccaaugcuuccgacagaaugggcauggggaugaccuaccuggcccuuauggcgacauuuaaaaugcgcccuauguucgcugucggacugcucuuuagacggcugaccucucgcgaggugcuccugcuuaccaucggccugagccucguggccuccgucgaacugcccaacagccuggaggaacuuggggauggacuggccaugggcaucaugauucucaagcugcucacagacuuccaaucucaucagcugugggcuacgcuucugucccucaccuuuaucaaaacaaccuucagccugcacuaugccuggaagacaauggcuaugguucugucuauugugucccuuuuuccccugugucucagcaccacgucucagaagacaaccuggcugccugugcuccuggggucccuuggaugcaaaccgcugaccauguuccugaucgccgagaauaagauuuggggcagaaaaagcuggccccucaacgaaggcaucauggcggucgggaucguguccauucugcuuagcucucugcucaagaacgauguuccucuggccggaccccucaucgcuggcgggaugcugauugccuguuacgugaucagcggauccucugcugaccuuagccuggagaaagccgccgaggucuccugggaagaggaagcugagcauucuggcgcgagccacaauauucugguggaaguucaggaugacgggacaaugaagaucaaagaugaggagcgggacgauacccucacaauccugcuuaaggccacgcugcucgcuguguccggagucuauccucugucuauucccgccacccucuucgugugguacuuuuggcaaaagaaaaagcagcgcagcggcguccugugggacacaccuagcccucccgaaguggagagagccguucuugaugacggcaucuaucggauuaugcagcgcgggcugcugggaagaagccaggugggcgucgggguguuccaagaaaacguuuuucauaccauguggcacgugacacggggagcuguccucauguaccagggcaaacgccuggagcccucuugggccuccgugaagaaagaccuuaucagcuacgggggaggcuggagacugcagggcucuuggaauaccggggaggaagugcagguuauugcggucgagcccggaaagaacccuaagaaugugcaaacggcucccggcaccuucaaaacauccgaaggggaggugggagccaucgcccucgauuuuaagccgggcaccagcggguccccuauugucaaccgggaaggaaaaaucgugggccuguauggcaaugggguugugacaaccucuggaacauacgucagcgcuaucgcccaggcgaaggcuucccaggagggcccccucccugagauugaagacgagguguucagaaaacgcaaccugacgaucauggaucuucaccccgggagcggaaagacccggagauaucugcccgccauuguucgcgaagccaucaagcggaaacugagaacacucauucuggcuccuacccgcguggucgccucugagauggcugaagcccuuaagggcaugccgauccgguaccaaaccacagcggugaaauccgagcauacggggaaggagaucguugaccugaugugccacgccaccuuuacaaugagacuccugagccccgugcgcgucccuaauuauaacaugauuaucauggaugaagcucauuucaccgaccccucuagcauugccgcucggggcuacaucuccacaagagugggaaugggcgaggccgccgcuauuuuuaugaccgcgacgccucccgggucugccgaggcuuucccucagagcaaugccgugauccaggaugaagaacgggacaucccggagcgcuccuggaacucuggauaugaguggauuacagauuuucccggcaaaaccgucugguucguuccuagcaucaaguccgggaaugacauugccaacugucugagaaagaauggaaaacgggugauccagcucagccgcaagaccuucgauacagaauaccagaagaccaagaacaacgacugggacuacguggucacaaccgauauuucugagaugggcgcuaauuuuagagccgaccgggugaucgaucccagacgcugccuuaaaccuguuauucugaaggacgggcccgaacgggugauccuggcgggcccgaugccugucacgguggcuuccgccgcccagagacgcggacggaucggcagaaaccacaauaaggagggggaucaguauauuuacaugggacagccccucaacaaugacgaggaucaugcucacuggacagaagccaaaaugcugcuugacaacaucaauacccccgagggcauuaucccugcgcuguucgaacccgagcgcgaaaagagcgccgcuauugauggggaguaucggcucagaggagaggcccgcaaaacauuuguugaacugaugagacggggcgaccugccuguguggcucuccuacaaggucgcuucugagggguuccaauauagcgaucgcagauggugcuuugacggcgaacggaacaaucaggugcuugaggaaaacauggaugucgagaucuggaccaaagagggagaacgcaagaaacugagaccgcgguggcuggacgccagaacguacuccgacccccucgcucugcgcgaguucaaggaauuugccgcgggccggagaucugugagcggggaucuuauccuggagauuggaaagcucccucagcaccugacccagcgcgcccaaaaugcucuggacaaccucguuaugcuucauaauuccgaacagggcgggcgggccuauagacacgcuauggaggagcugcccgauacaaucgaaacccugaugcuccuggcccuuauugccgugcugacaggaggcgugacccucuucuuucugagcggccgggggcugggaaaaacaucuaucggccuccuuugugucauggcuuccagcguucugcuguggauggcgucuguggagccucauuggauugccgcuuccaucauccucgaguucuuucugauggugcuucugauucccgagccggaccgccagagaaccccucaggauaaccaacucgccuacgucgugaucgggcugcuguucaugauucucacgguugccgcuaaugagaugggacuucuggaaacaaccaagaaagaccugggcaucgggcacguggccgucgagaaccaccaucacgcggccaugcucgauguggaccugcaucccgcuagcgccuggacccuuuacgcugucgccacaaccauuaucacaccuaugaugcggcacacgauugaaaacaccacagcgaauaucucucugaccgccaucgcuaaccaggccgcuauucucaugggacuggauaagggcuggcccaucagcaaaauggacauuggcgugccucugcucgcccuugggugcuauucccagguuaauccccugacacugaccgcugccgugcucaugcuggucgcgcauuacgccaucauuggaccgggccuucaagcuaaggccacgcgcgaggcucagaagagaaccgccgccgggaucaugaaaaacccuacaguggauggaaucguugcgauugaccuggaucccguggucuaugacgcuaaguuugaaaaacagcucggccagaucaugcugcugauucucuguaccucucaaauccuucugaugcggacaaccugggcccugugcgagagcauuacgcucgcuacagggccccugaccacacuuugggagggauccccuggcaaguucuggaauaccaccaucgccgugagcauggccaacaucuuccgcggcuccuaccuggcuggggccggacucgcguuuucucugaugaaaagccugggcgggggaagacggggcacaggggcccagggagaaacgcucggcgagaaguggaagcgccagcuuaaucagcuguccaaaucugaguucaacaccuauaagagaagcggcauuauggagguggaccgguccgaagcuaaagaggggcugaagagaggagagacaaccaaacacgccguuucucgcggcacagcuaagcuccggugguuugucgaaagaaaucuggugaagccggaggggaaagugaucgaucuuggauguggccgcgggggauggagcuacuauugcgccggccugaagaaagucaccgaaguuaagggcuacacgaaagggggacccggccacgaggaaccuauucccauggcgacauacggguggaaccucgugaagcugcauuccggaaaagacguguucuuugucccucccgagaagugugauacccugcucugcgacaucggcgagagcucuccuaauccgaccauugaagaggggcggacacuuagagugcugaagaugguugaacccuggcugcgcggaaaccaauucuguaucaaaauucucaauccuuauaugcccuccguggucgagacccuggagcagaugcagcggaagcacggcggcaugcuugugagaaacccucugagccgcaauucuacacaugaaauguacuggguuuccugcgggacgggaaacaucgugagcgccgucaauaugaccucucggaugcuccugaacagauuuacaauggcucaccgcaaacccaccuaugagcgggauguggaccugggcgccgggacaagacacguggcugucgaaccggagguugccaaccucgauaucauuggacagcgcaucgaaaauauuaagcaugagcacaaauccaccuggcauuacgacgaggauaacccuuauaagacgugggcuuaccacggcagcuaugaagugaagcccuccgggagcgccucuagcauggugaauggagucgugaaacugcuuaccaagcccugggacguuaucccuauggugacacaaauugcgaugaccgauacaacccccuucggccagcagagagucuuuaaagagaagguggacacacggaccccuaaagccaagcgcggcacggcucaaaucauggaaguuacagccaaguggcuguggggguuccucuccagaaacaaaaagccgcggaucuguaccagagaggaauuuacccggaaagugcgcucuaaugcugccauuggagccgucuucguggacgagaaccaguggaauagcgcgaaggaggcuguugaagaugagagauuuugggaccuggugcaucgggaacgcgagcuucacaaacagggcaagugcgccacaugcgucuacaacaugauggggaagagagagaagaagcugggagaguucggcaaagccaaggggucccgggcuaucugguacauguggcucggcgcccgcuuccuggaguuugaagcucugggauucaugaaugaggaucacugguuuucuagagaaaacagccucuccggcguggagggggagggacugcauaaacuuggcuauauucugcgggacaucucuaagauuagcgggggaaauauguacgccgaugacacggcgggcugggauacccgcaucacagaagacgaucuccagaacgaggccaaaaucaccgacauuauggaacccgagcacgcucugcuugccaaguccaucuucaagcugacauaucaaaauaaagucgugagaguucagcggccugcuaagaacgggaccgugauggaugucauuagccgcagagaccagcggggcucuggacaggugggcacauacgggcucaauaccuuuacgaacauggaagcccaacugauccgccagauggaguccgagggaauuuucagccccucugaacuggagaccccuaaccucgcggaaagagcccuggauuggcuugagaaacauggcguggaacggcugaagagaauggcuaucuccggggacgacuguguugugaaacccaucgaugaccgcuuugccacagcucucaccgcccugaaugauaugggaaagguccggaaggacauuccgcagugggagccuagcaaaggcuggaacgauuggcagcaagugcccuucugcucccaccacuuucaucagcuuaucaugaaggacgggagagagauuguugugccuugucgcaaucaggaugaacuggucggccgggcuagagugucucagggagccggcuggagccucaaagagacagcgugccuggggaaguccuaugcccaaauguggcagcugauguacuuccaccgccgggaccucagacuggcugccaacgccaucuguagcgcuguccccguggauuggguuccuaccucucgcacgacaugguccauucaugcccaccaucaguggaugaccacagaagacaugcuuagcguguggaaucgggucuggaucgaggaaaaccccuggauggaggauaaaacccacauuucuagcugggaggacgugccguaucugggaaagagagaagaccaauggugcggcucccucaucgggcugacggcgcgcgcuaccugggccacaaauauccagguugccauuaaccaggugcggagacuuaucggaaaugagaacuaccuggauuacaugaccucuaugaagcgguuuaaaaaugaaagcgacccugagggcgcucucugguga

SEQ ID NO: 18566 - RNA, 9879 nt, Artificial Sequence
  derived and/or modified CDS sequence (opt5) from DENV-1__FJ639688__SS-prME
agcgugaccaugcugcucaugcugaugcccacagcccuugcuuuccaccugacgaccagaggcggggaaccucauaugaucguguccaagcaggaacgggggaaaucucuccuguuuaagacaagcgccggcguuaauaugugcacccuuauugccauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaaguucacaguuguggucggagauguggcuggcauucucgcccaggggaaaaagaugauccggccgcaacccauggaguacaaauauucuuggaaaagcuggggaaaggccaagauuaucggcgcugacgugcagaauaccaccuuuaucauugaugggccuaacacacccgaauguccugacgaucagagagcguggaaugucugggagguugaggacuacggauucggcaucuuuaccacgaacauuuggcugaagcugcgcgauuccuauacacaggugugcgaccaccggcuuaugagcgccgcuaucaaagauucuaaggccgugcacgccgacaugggcuacuggauugaauccgagaaaaaugaaaccuggaagcucgcuagagccagcuucaucgaggucaagacauguaucuggcccaaaucucauacccugugguccaacggggugcuggaaagcgagaugauuaucccgaagauuuauggaggcccuaucucucaacacaauuaccgccccggguacuucacacagaccgcgggaccuuggcaucucggcaaacuggagcuugauuuugaccugugcgaagggacgaccguuguggucgaugagcacugcggaaaccggggccccagccucagaacaaccacagugaccggcaagauuauccacgaaugguguugccgguccuguacgcugccuccccugcgcuucagaggggaggacggaugcugguauggcauggagauccggccgguuaaagaaaaggaggaaaaucuugucaagagcauggucucugcuggguccggagagguggacagcuuuucccucggccugcuguguauuucuaucaugauugaagagguuaugagaagccgcuggucccggaaaaugcucaugacagggacccuggccguguucuuucuucugaucaugggacagcucacauggaacgaucugauuagacugugcaucauggucggcgccaaugcuucugaccgcaugggcauggggaccaccuaccuugcccugauggcgacauucaagaugagaccuauguuugcugugggacuccuguuccggcgccucacgagcagagaggugcugcuucugaccauuggccucucccuggucgccucuguugaacugcccacaagccuugaggaacugggggauggacucgccaugggcaucaugauccugaaacuccugaccgacuuucaaucccaucagcuuugggcuacacugcucagccugaccuucauuaagacgacauuuucucugcacuaugccuggaaaaccauggcuauggugcuuuccaucgugagccugcucccccugugucucucuaccacaucccagaagaccacauggcugccuguccuucuggggagccugggaugcaagccgcucacgauguuccugauugccgagaacaaaaucuggggccggcgcucuuggccccuuaaugaaggcauuauggcgguggggaucguuuccauccugcucagcucccugcucaagaacgaugugccucuggccggaccccuuauugcuggcgggaugcugaucgccuguuacgucauuagcggaucuagcgcugaccugucccucgagaaagccgccgaggugucuugggaagaggaagcugagcauagcggcgcgucccacaacauccugguugaagugcaggaugacgggaccaugaagauuaaagaugaggagagagacgauacacuuaccauccugcucaaggccacacugcucgcugucucuggaguguauccucugagcauccccgccacccuuuuugucugguacuucuggcagaagaagaagcagcgguccggcgugcugugggacacgccuucucccccggaaguugagcgcgccgugcuggaugacggcauuuauagaaucaugcagcgggggcuccugggacgcagccaggucggcguggggguuuuccaagaaaauguguuucauaccauguggcacgucacaagaggagcugugcuuauguaccagggcaaacggcuggagccuuccugggccagcgugaagaaagaccucauuucuuacgggggaggcuggagacugcagggcuccuggaacaccggggaggaaguucaggucaucgcgguggagcccggaaagaauccuaaaaacgugcaaacagcucccggcaccuucaagacaccggaaggggaggucggagccauugcccucgauuuuaagccuggcacgagcgggucucccaucgugaaucgcgaaggaaaaauuguuggccuguauggcaacgggguggucaccacauccggaaccuacgugagcgcuaucgcccaggcgaaggcuucccaggagggcccucuucccgagaucgaagacgagguuuuccggaaaagaaaucugaccauuauggaucugcaccccgggucuggaaagacacgccgguaucucccugccaucgugagagaagccauuaaacgcaagcugcggacgcuuauccuggcuccgaccagagucguggccagcgagauggcugaagcccucaagggcaugcccauucgcuaccaaacaaccgcgguuaaauccgagcauacagggaaggagaucguggaccugaugugccacgccaccuuuacgaugcggcugcucagcccugucagagugcccaacuauaauaugaucauuauggaugaagcucauuucacagacccuucuuccaucgccgcucggggcuacauuagcacccgcgugggaaugggcgaggccgccgcuaucuuuaugaccgcgacacccccugggucugucgaagccuucccgcagagcaacgcuguuauucaggaugaggaaagagacauccccgagcgguccuggaacucuggauaugaguggaucaccgauuuuccuggcaaaacagugugguucgugcccagcauuaaguccgggaacgacaucgccaauugucuucgcaaaaacggaaagagagucauucagcugucucggaagaccuuugauacggaauaccagaaaacaaagaauaacgacugggacuacgugguuaccacagauaucagcgagaugggcgccaacuucagagcugaccgcgugauugauccucggagaugccugaaacccgucauccucaaggacgggccggaacgcgugauucuggccggcccuaugcccguuaccguggcguccgcugcccagcggagaggacgcaucggccggaaucacaacaaagagggggaucaguauaucuacaugggacagccccuuaauaacgacgaggaucaugcccacuggacggaagcuaagaugcugcucgacaauauuaacaccccugagggcaucauucccgcccuguucgaaccugagagagaaaagagcgcggccaucgauggggaguaucgccugagaggagaggcucggaaaacauuugucgaacucaugcgcagaggcgaccuuccgguguggcugucuuacaaggucgccuccgagggguuccaauauagcgaucggcgcuggugcuuugacggcgaaagaaauaaccaggugcuggaggaaaauauggauguugagauuuggaccaaagagggagaacggaagaaacucagaccccgcuggcuggacgcucggacauacuccgacccucuugcccugagagaguucaaggaauuugcugccggccgccggucugugagcggggaucucauccuggagaucggaaaacugccccagcaccucacccagagagcgcaaaacgcccuugacaaucuggugaugcugcauaacuccgaacagggcgggcgggcuuaucgccacgccauggaggagcucccugauacaauugaaacccugaugcuucuggcucucaucgccguccugacgggaggcguuacacuguucuuucucucuggcagagggcuuggaaagaccagcauuggccugcugugugugauggccuccagcgugcuccuguggauggcuucugucgagccccauuggaucgcggccuccauuauccuugaguucuuucugauggugcuccugaucccggagccugaccggcagcgcacaccccaagauaaucaacuggcuuacguugugauugggcuccuuuucaugauccugaccgucgccgccaacgagaugggacugcucgaaaccacaaagaaagaccugggcauugggcacguggcugccgagaaucaccaucacgcggccaugcuugaugucgaccugcauccugcuagcgccuggacgcucuacgcuguggccaccacaaucauuacccccaugaugagacacacaaucgaaaacaccacggcgaacauuucucugaccgccaucgcuaaucaggccgcuauccugaugggacucgauaagggcuggccuauuuccaaaauggacaucggcguuccccuucuggcccuggggugcuauagccaggugaacccgcucacacugaccgcugccguccuuaugcugguggcgcauuacgccauuaucggaccuggccuccaagcuaaggccacacgggaggcucagaaacgcaccgccgccgggauuaugaagaaucccacgguugauggaaucguggcgaucgaccuggaucccgucguguaugacgcuaaguuugaaaaacagcugggccagauuaugcuccuuauccuguguacaucucaaauucugcucaugagaaccacaugggcccugugcgagagcaucacccuugcuaccgggccucugacaacgcucugggagggauccccgggcaaguucuggaacaccacaauugccgugucuauggccaauaucuuucggggcagcuaccuggcuggggccggacuggcguucucccucaugaaaagccuuggcgggggacgcagaggcaccggggcccagggagaaacacugggcgagaaguggaaacggcagcugaaccagcucuccaagucugaguucaauaccuauaagagaagcggcaucauggagguugaccgcuccgaagcuaaagaggggcugaagcggggagagacgacaaaacacgccgucucuagaggcaccgcuaaacuucgcugguuuguggaacggaaccuggugaaacccgaggggaaggucauugaucucggauguggcagagggggauggagcuacuauugcgccggccugaagaaaguuaccgaagugaagggcuacacaaaagggggaccuggccacgaggaacccaucccuauggcgaccuacggguggaaucuggugaagcuccauuccggaaaagacgucuucuuuauucccccugagaagugugauacacuucugugcgacaucggcgagucuagcccgaaccccacgauugaagaggggcgcacccugcgggugcucaaaaugguugaaccuuggcugagaggaaaucaauucuguaucaagauucuuaaccccuauaugccuuccguggucgagacacuggagcagaugcagcgcaagcacggcggcaugcucgugcggaauccccugagcagaaacucuacccaugaaauguacuggguuuccugcgggacaggaaauaucgugagcgccgucaacaugaccucucgcaugcugcucaaucgguuuacgauggcucacagaaaaccgaccuaugagcgcgauguggaccugggcgccgggacaagacacguggcugucgaaccugagguugccaaccuugauaucauuggacagcggaucgaaaacauuaagcaugagcacaaauccaccuggcauuacgacgaggauaaucccuauaagacaugggcuuaccacggcagcuaugaagugaaacccucuggguccgccagcuccauggugaacggagucgugaagcugcucaccaagccuugggacguuauccccauggugacacaaauggcgaugaccgauacgacaccuuucggccagcagcgcgucuuuaaagagaagguggacaccagaaccccgaaagccaagcggggcacagcucaaauuauggaaguuacggccaaauggcuguggggguuccuuagcagaaauaagaagccccggaucuguacccgcgaggaauuuacaagaaaagugcggucuaacgcugccaucggagccgucuucguggacgagaaucaguggaacagcgcgaaggaggcuguugaagaugagcgcuuuugggaccuggugcauagagaacgggagcuccacaaacagggcaagugcgcgaccugcgucuacaauaugauggggaaacgcgaaaagaagcugggagaguucggcaaagccaagggguccagagcuauuugguacauguggcugggcgcccgguuucucgaguucgaagcucugggauucaugaacgaggaucacugguuuucucgcgaaaauagccuuuccggcguggagggggagggacugcauaaacucggcuauauccugagagacauuucuaagaucccugggggaaacauguacgccgaugacacagcgggcugggauacccggauuacagaagacgaucuucagaaugaggcccgcaucaccgacaucauggaacccgagcacgcucugcucgccaaaagcauuuucaagcugacguaucaaaacaaagucgugagaguucagcggccugcuaagaaugggaccgugauggaugucaucucccgcagagaccagcggggcucuggacaggugggcacauacgggcugaacaccuuuacaaauauggaagcccaacucauuagacagauggagagcgagggaaucuucucccccagcgaacuggagaccccgaaccuugcggaacgcgugcuggauuggcucgagaaguauggcguugaacggcugaaaagaauggccauuucuggggacgacuguguggucaagccuaucgaugaccgcuuugcuacggcccuuacagcucugaacgauaugggaaaagugcggaaggacaucccccagugggagccuuccaaaggcuggaaugauuggcagcaaguucccuucugcagccaucacuuucaccagcucauuaugaaggacgggagagagaucguggucccuugucgcaaccaggaugaacuggugggccgggccagagucucucagggagcuggcuggucccugcgcgagaccgccugccucggaaagagcuacgcgcaaauguggcagcugauguauuuccaucggagagaccuucgccuggccgcuaaugccauuuguuccgccgugcccguugauuggaucccgacaucucggaccacguggagcauucacgcucaucaccaguggaugaccacagaagacaugcucuccguguggaacagagucuggaucgaggaaaauccuuggauggaggauaaaacccauauuagcucuuggggagacgugcccuaccugggcaagcgggaggaccaauggugcgggucccuuaucggacugacagccagagcgaccugggcuacaaacauccagguugccauuuaccaggugcgccggcucaucggcaaugaaaacuaucuggauuacaugaccagcaugaaaagauuuaagaaugagucugaccccgaaggggcccugugguga

SEQ ID NO: 18567 - RNA, 9879 nt, Artificial Sequence
  derived and/or modified CDS sequence (opt5) from DENV-1__FJ639689__SS-prME
agcgugaccaugcugcucaugcugaugcccacagcccuugcuuuccaccugacgaucagaggcggggagccucauaugauugucuccaagcaggaacggggaaaaucucuccuguuuaagaccagcgccggcguuaacaugugcacacuuaucgcgauggaccugggggagcucugugaagauaccaugacauacaaaugcccgcgcauuaccgaggcugaacccgacgauguggacuguuggugcaaugccacagauaccugggugacguauggaaccuguucccaaacaggcgagcacagacgggacaagcgcucugucgcccuggcuccucauguggggcugggacucgagaccagaacagaaaccuggaugagcuccgagggcgccuggaaacagauccagcggguugaaacgugggcucugcgccaccccggcuucacagugauugcccuuuuucuggcgcaugccaucgggaccucuaucacacagaagggaauuaucuucauucuccugaugcuugucaccccuagcauggcuaugagaugcgugggcaucgggucccgggauuuuguugagggacugagcggcgccaccuggguggacgucgugcucgagcacgggucuugugugacaacgauggcuaaggauaaacccacccuggacauugaacugcucaagacagaggucaccaacccugccauccugcgcaaacuuugcauugaagcgaagaucuccaauacaaccacggauagcagauguccgacacaaggagaggccacccugguugaagagcaggacgcuaacuucgugugccggcgcaccuuuguggauagaggcuggggcaauggguguggacucuucggcaaagggucucugaucacaugcgccaaguuuaagugcgucaccaaacuugagggaaagauugugcaguacgaaaaccugaaauauuccguuaucgugacaguccacacgggcgaccagcaucaaguggggaaugagagcaccgaacacggaacaaccgcuacaauuaccccccaggccccuacgaccgagauccagcucacagacuacggcgcccugacccuggauuguucuccccggacaggccucgacuucaacgaaaugguucugcuuaccaugaaggagaaauccuggcuggugcauaagcagugguuucucgaucugccucuucccuggacgagcggggcuuccacaucucaagagaccuggaaucgccaggaccugcucgucacauucaaaaccgcgcacgccaagaagcaggaaguggucgugcugggaagccaagagggcgcuaugcacaccgcccugacaggggccacggaaauucagaccuccggaacaaccacaaucuuugcuggccaucucaaaugcagacugaagauggauaaacuuacccugaaggggaugagcuauguuauguguacgggcucuuucaaacucgagaaggaaguggccgagacacagcacggaaccguccuggugcagaucaaguacgagggcaccgacgcgccgugcaaaauuccuuucuccacacaagaugaaaaggggguuacccagaacggacggcugaucacagcuaaucccauugugacggacaaagagaagccugucaacaucgaagccgagccccccuuuggcgagagcuauauugugaucggggccggagaaaaagcucuuaagcucucuugguucaagaaaggcagcuccaucgggaagauguuugaggccaccgcuagaggcgcccgccggauggcgauucugggagauacagccugggacuucggcucuaucgggggaguguuuaccagcguuggcaaacugguccaucagauuuucgggacagcuuacggagugcucuuuuccggcgugagcuggaccaugaagaucgggauuggcguccugcuuacguggcugggacucaauucuagauccaccagcuucucuaugacauguaucgccgugggccugguuacccuguaccuuggggugaugguccaggcugauuccggaugcgugauuaacuggaaaggccgcgaacucaagugugggagcggaaucuuuguuacaaaugaggugcacaccuggacagaacaauauaaguuccaggccgacuccccuaaacggcugucugcggccaucggcaaggcuugggaggagggggucugcggcauuagaagcgccacccgccuggaaaacaucauguggaaacagauuuccaacgagcucaaucauauccugcuugaaaacgacaugaaguuuacggugguugugggagaugucgcuggcauucuggcccaggggaaaaagaugauccggccgcaacccauggaguacaaauauucuuggagaagcuggggaaaggccaagaucauuggcgcugacgugcagaauacaaccuucaucauugaugggccuaacacccccgaauguccugacgaucagcgcgcguggaauaucugggagguggaggacuacggauuuggcauuuucacaaccaacaucuggcucaaacugcgggauuccuauacgcaggucugcgaccacagacugaugagcgccgcuaucaaggauucuaaagccguucacgccgacaugggcuacuggauugaauccgagaagaaugaaacauggaaacuugcucgcgccagcuucaucgaggugaagaccuguguguggcccaagucucauacacucugguccaacgggguccuggaaagcgagaugauuaucccgaaaauuuauggaggcccuaucucucaacacaauuaccggcccggguacuuuacccagacagcgggaccuuggcaucugggcaagcucgagcuggauuucgaccuuugcgaagggaccacggugguuguggaugagcacugcggaaacagaggccccagccugcggaccacaaccgucacaggcaaaaucauucacgaaugguguugccgcuccuguacccucccuccccugagauuucggggggaggacggaugcugguauggcauggagaucagaccggugaaggaaaaagaggaaaaucugguuaagagcauggugucugcuggguccggagaggucgacagcuucucccuuggccuccuguguauuucuaucaugacggaagaggugaugcgcagccggugguccagaaagaugcugaugacagggacccucgccguuuuucugcuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccgugggccucucccuggucgccucuguugaacugcccaacagccuugaggaacugggggauggacucgccaugggcaucaugauccugaagcuccugacagacuuucaaccccaucagcuuugggcuacccugcucucccugacauucauuaaaaccacguuuagccugcacuaugccuggaagacaauggcuauggugcuuucuaucgugucccuguucccucucugucugagcaccaccucucagaaaacaaccuggcucccgguccugcuugggucccugggaugcaagccccugacaauguuucucauugccgagaauaagaucuggggccgcagaagcuggccucugaacgaaggcauuauggcgguggggaucguuucuauccuucuguccagccuccugaaaaacgaugugccccucgccggaccucugauugcuggcgucaugcuuaucgccuguuacgugauuuccgggagcucugcugaccugagccuggagaaggccgccgagguuuccugggaagaggaagcugagcauucuggagcgagccacaauauccucguggaaguccaggaugacggcacgaugaaaauuaaggaugaggagcgggacgauacccugacaauccuucugaaagccacccuccuggcuguguccggggucuauccccucucuaucccugccacacuguucgugugguacuucuggcaaaagaaaaagcagcgcagcggaguucuuugggacacccccuccccgccugaaguggagagagccguccuggaugacggcauuuaucggaucaugcagcgcggccugcucgggagaucucaggugggaguuggcguguuucaagaaaacgucuuccauacgauguggcacgugacccggggggcugugcugauguaccagggaaagagacuugagcccagcugggccuccguuaaaaaggaccugauuagcuacggcgggggauggcgccuccagggcucuuggaauacaggcgaggaaguccaggugaucgcgguggagccugggaaaaaccccaagaauguccaaaccgcuccgggaacauuuaaaaccccugaaggcgaggugggggccauugcccuggauuucaagcccggaacauccggcagcccuaucguuaaccgggaagggaagauugugggacucuauggcaauggcgucgugacgaccucugggacauacguuuccgcuaucgcccaggcgaaagcuagccaggagggaccccugcccgagaucgaagacgagguguuuagaaagcgcaaccuuaccauuauggaucugcacccuggcuccgggaaaacccggagauaucugccggccaucguccgcgaagccauuaagcggaaacucagaacacugauccuugcucccacgcgcgugguugccucugagauggcugaagcccugaagggaaugccuauucgguaccaaaccacagcggugaagagcgagcauaccggcaaagagaucgucgaccucaugugccacgccacauucaccaugagacugcugucccccgugcgggugccuaauuauaacaugaucauuauggaugaagcucauuuuacggaccccagcucuaucgccgcucgcggguacauuuccacaagagucggcaugggagaggccgccgcuaucuucaugaccgcgaccccuccgggcagcguugaagccuuuccccagucuaaugcugugauucaggaugaggaacgggacaucccugagcgcagcuggaacuccggguaugaguggaucacagauuuccccggaaagaccgugugguuugucccuucuauuaaaagcggcaaugacaucgccaacugucucagaaagaaugggaaacgggugauucagcuuuccagaaagacauucgauaccgaauaccaaaagacgaaaaacaacgacugggacuacguugugacaaccgauaucucugagaugggagccaauuuccgcgcugaccgggucauugaucccagacgcugccugaagccggugauccugaaagacggcccugaacggguuauucucgccgggcccaugcccgugacagucgcgagcgcugcccagagacgcggccggaucggaagaaaccacaauaaggagggcgaucaguauaucuacauggggcagccucugaacaaugacgaggaucaugcccacuggaccgaagcuaaaaugcuucuggacaacauuaauacgcccgagggaaucauuccugcccucuuugaaccggagcgcgaaaaguccgcggccaucgauggcgaguauagacugcggggggaggcucgcaagaccuucguggaacugaugagacggggagaccuccccgucuggcuuagcuacaaaguggccucugagggcuuucaauauuccgaucgcagauggugcuucgacggggaacggaacaaucagguucuggaggaaaacauggauguggagauuuggacaaaggagggcgaaagaaaaaagcugcgcccucgguggcucgacgcuagaaccuacagcgacccccuggcccuucgcgaguuuaaagaauucgcugccggacggagauccgugucuggcgaucugauccucgagaucgggaagcugccucagcaccugacacagcgggcgcaaaaugcccucgacaaccuugucaugcugcauaauagcgaacagggaggccgcgcuuauagacacgccauggaggagcugcccgauaccauugaaacacucaugcugcuugcucugaucgccguucucaccgggggagugacgcuguuuuuccuguccggccggggccucgggaaaacaucuauuggacuucugugugugauggccagcuccguccugcucuggauggcuagcguggagccgcauuggaucgcggccucuauuauccuggaauuuuuccuuaugguucugcucaucccugagcccgaccgccagagaaccccucaggauaaccaacuggcuuacguggucauuggccugcucuuuaugauccuuaccguggccgccaaugagauggggcugcuggaaacaaccaagaaggaccucggaauuggccacgucgcuguggggaaccaccaucacgccgcgaugcuggauguugaccuucaucccgccuccgcuuggacacuguacgccguggcuacgaccaucauuacaccuaugaugcggcacaccaucgagaacacaaccgccaauauuagccucacggcgaucgccaaccaggcugccauccugaugggacuggauaaaggcuggcccauuucuaagauggacaucggcgucccgcuccuugcucuggggugcuauucccaggugaauccucugacccucacagccgcuguucugaugcuuguggcccauuacgcgauuaucggacccggccugcaagccaaagcuacccgcgaagcccagaagagaacagcugccgggauuaugaaaaaccccaccgucgauggaaucguggccaucgaccucgauccugugguuuaugacgcgaaguucgagaagcagcugggccagauuaugcugcucauccuuuguacgagccaaauucugcugaugcggacaaccugggcucucugcgaaucuaucacacuggccaccgggccgcuuaccacacugugggagggaagccccggcaaauuuuggaauacgaccauugcugucuccauggccaacaucuuccgcggcucuuaccucgccggggcuggacuggccuucagccugaugaagucccucggcgggggaagacggggcacaggggcgcagggagagacccuuggcgaaaaauggaagagacagcugaaucagcugagcaaauccgaguuuaacacauauaagcgcucuggcaucauggaaguggaccggagcgaggccaaggaagggcucaaaagaggagagauuaccaagcacgcugugucccgcggcacggccaaacugcggugguucgucgagagaaaucuuguuaagccugaagggaaagugaucgaucugggauguggccgcgggggauggucuuacuauugcgcuggccucaagaaggugacagaggucaaaggcuacaccaaggggggacccggccacgaagagccuauucccauggccaccuacggguggaaccuggugaaacugcauagcggaaaggacguuuuuuucgugccuccggaaaaaugugauacacuccuuugcgacaucggcgaguccucucccaauccuaccauugaggaagggcggacacugagaguccugaagaugguggagcccuggcuccgcggaaaccaauuuuguaucaaaauucugaauccuuauaugcccagcguuguggaaacgcuugagcagaugcagcggaagcacggcggcaugcuggucagaaacccgcucucccgcaauagcacccaugagauguacugggugucuugcgggacaggaaacaucguguccgcggucaauaugaccagccggaugcugcugaacagauucacaauggcccaccgcaagccuaccuaugaaagagauguugaccucggcgcugggacgcggcacguggccguggagcccgaagucgcuaaccuggauaucauuggacagcgcaucgagaauauuaaacaugaacacaagucuaccuggcauuacgacgaggauaaccccuauaaaacaugggccuaccacggcuccuaugaggugaagccuagcgggucugcuuccagcaugguuaauggaguggucaaacuucugaccaagcccugggacgugaucccuaugguuacacaaauugccaugaccgauacaaccccguuuggccagcagagaguguucaaggaaaaagucgacacgcggacacccaaggcgaaaagaggcaccgcccaaaucauggaggugaccgcuaaguggcucuggggguuucugucccggaacaaaaagccucgcaucuguacaagagaagaguucacgcggaagguucgcagcaaugccgcuauuggagccguguuugucgacgaaaaccaguggaauucugccaaagaggcgguggaggaugaaagauucugggaccuuguccaucgggagcgcgaacugcacaagcagggcaaaugcgcuaccugcguguacaacaugauggggaagagagagaaaaagcucggagaauuuggcaaggccaaagggagccgggccaucugguacauguggcugggcgcucgcuuccuggaguucgaggcccucggauuuaugaaugaagaucacugguucuccagagagaacucucugagcggcguugaaggggagggacuucauaagcugggcuauauucuccgggacaucuccaaaauucccgggggaaauauguacgcugaugacacagccggcugggauacccgcaucacagaggacgaucugcagaacgaagcgagaaucaccgacauuauggagccugaacacgcccuucuggcuaagucuaucuuuaaacucacauaucaaaauaaggugguccgggugcagcgccccgccaaaaacgggaccgugauggauguuauuagcagacgggaccagagaggcuccggacaggugggcacguacgggcugaauaccuucacaaacauggaggcucaacugauccgccagauggaaucugagggaauuuuuagcccguccgagcucgaaaccccuaaccuggccgagcggguccuugauuggcuggaaaaguauggcguggagagacucaagcgcauggcgaucagcggggacgacuguguugugaaacccaucgaugaccgguucgccacagcucugaccgcccuuaaugauaugggaaaggucagaaaagacauuccucagugggaacccucuaagggcuggaacgauuggcagcaagugccuuuuugcucccaucacuuccaccagcugaucaugaaagacgggcgcgagauugucgugcccugucggaaucaggaugagcucguuggcagagcucgcgugagccagggagccggcuggucucugcgggaaacggcuugccuggggaaguccuacgcccaaauguggcagcucauguauuuucauagacgcgaccugcggcuugcggccaacgcuaucuguagcgccgucccgguggauuggauuccuacauccagaaccacauggucuauccacgcccaucaccaguggaugaccacggaggacaugcugagcguuuggaaucggguguggauugaagagaaccccuggauggaagauaagacccauaucuccagcuggggagacguccccuaccucggcaaaagagaggaccaauggugcgggucucugaucggacuuacagcucgcgccaccugggcgacaaauauucagguggcuaucaaccaggugcggagacugauuggcaaugagaacuaccucgauuauaugaccuccaugaagcgcuucaaaaaugaaagcgacccugagggggcccugugguga

SEQ ID NO: 18568 - RNA, 9879 nt, Artificial Sequence
  derived and/or modified CDS sequence (opt5) from DENV-1__FJ639690__SS-prME
agcgugaccaugcugcucaugcugaugcccacagcccuugcuuuccaccugacgaucagaggcggggagccucauaugauugucuccaagcaggaacggggaaaaucucuccuguuuaagaccagcgccggcguuaacaugugcacacuuaucgcgauggaccugggggagcucugugaagauaccaugacauacaaaugcccgcgcauuaccgaggcugaacccgacgauguggacuguuggugcaaugccacagauaccugggugacguauggaaccuguucccaaaucggcgagcacagacgggacaagcgcucugucgcccuggcuccucauguggggcugggacucgagacaagaaccgaaacauggaugagcuccgagggcgccuggaaacagauucagcggguugaaaccugggcucugcgccaccccggcuucacggugaucgcccuuuuucuggcgcaugccaucgggacaucuauuacccagaagggaaucauuuucauccuccugaugcuugucacaccuagcauggcuaugagaugcgugggcauugggucccgggauuuuguugagggacugagcggcgccaccuggguggacgucgugcucgagcacgggucuugugugaccacaauggcuaaggauaaacccacgcuggacaucgaacugcucaagaccgaggucacaaacccugccauucugcgcaaacuuugcaucgaagcgaagaucuccaauaccacaaccgauagcagauguccgacgcaaggagaggccacacugguugaagagcaggacgcuaacuucgugugccggcgcaccuuuguggauagaggcuggggcaauggguguggacucuucggcaaagggucucugauuaccugcgccaaguuuaagugcgucacaaaacuugagggaaagaucgugcaguacgaaaaccugaaauauuccguuauugugaccguccacacaggcgaccagcaucaaguggggaaugagagcacggaacacggaaccacagcuaccaucacaccccaggccccuaccacggagauucagcucaccgacuacggcgcccugacacuggauuguucuccccggaccggccucgacuucaacgaaaugguucugcuuacaaugaaggagaaauccuggcuggugcauaagcagugguuucucgaucugccucuucccuggaccagcggggcuuccacgucucaagagacauggaaucgccaggaccugcucgucaccuucaaaacagcgcacgccaagaagcaggaaguggucgugcugggaagccaagagggcgcuaugcacaccgcccugaccggggccacagaaauccagacguccggaaccacaaccaucuuugcuggccaucucaaaugcagacugaagauggauaaacuuacacugaaggggaugagcuauguuauguguaccggcucuuucaaacucgagaaggaaguggccgagacgcagcacggaacaguccuggugcagauuaaguacgagggcaccgacgcgccgugcaaaaucccuuucuccacccaagaugaaaaggggguuacacagaacggacggcugauuaccgcuaaucccaucgugacagacaaagagaagccugucaacauugaagccgagccccccuuuggcgagagcuauaucgugaucggggccggagaaaaagcucuuaagcucucuugguucaagaaaggcagcuccauugggaagauguuugaggccacggcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacaaugaagauugggaucggcguccugcuuaccuggcugggacucaauucuagauccacgagcuucucuaugaccuguauugccgugggccugguuacacuguaccuuggggugaugguccaggcugauuccggaugcgugaucaacuggaaaggccgcgaacucaagugugggagcggaaucuuuguuaccaaugaggugcacacauggaccgaacaauauaaguuccaggccgacuccccuaaacggcugucugcggccauuggcaaggcuugggaggagggggucugcggcaucagaagcgccacacgccuggaaaacauuauguggaaacagaucuccaacgagcucaaucauauucugcuugaaaacgacaugaaguuuaccgugguugugggagaugucgcuggcauccuggcccaggggaaaaagaugauccggccgcaacccauggaguacaaauauucuuggagaagcuggggaaaggccaagauuaucggcgcugacgugcagaauacgacauucauuaucgaugggccuaacacccccgaauguccugacgaucagcgcgcguggaauauuugggagguggaggacuacggauuuggcaucuucaccacaaacaucuggcucaaacugcgggauuccuauacccaggucugcgaccacagacugaugagcgccgcuauuaaggauucuaaagccguucacgccgacaugggcuacuggaucgaauccgagaagaaugaaacguggaaacuugcucgcgccagcuucauugaggugaagacauguguguggcccaagucucauacccucugguccaacgggguccuggaaagcgagaugaucauuccgaaaaucuauggaggcccuaucucucaacacaauuaccggcccggguacuuuacacagaccgcgggaccuuggcaucugggcaagcucgagcuggauuucgaccuuugcgaagggacaaccgugguuguggaugagcacugcggaaacagaggccccagccugcggacgaccacagucaccggcaaaauuauccacgaaugguguugccgcuccuguacacucccuccccugagauuucggggggaggacggaugcugguauggcauggagauuagaccggugaaggaaaaagaggaaaaucugguuaagagcauggugucugcuggguccggagaggucgacagcuucucccuuggccuccuguguaucucuauuaugaccgaagaggugaugcgcagccggugguccagaaagaugcugaugacggggacacucgccguuuuucugcuucugaucaugggacagcucaccuggaacgaucugauucgccugugcaucauggugggcgccaaugcuucugacagaaugggcauggggacaaccuaccuugcccugauggcgaccuucaaaaugcggccuauguuugcugucggacuccuguuccgcagacucacaagccgggaggugcugcuucugacggugggccucucccuggucgccucuguugaacugcccaacagccuugaggaacugggggauggacucgccaugggcaucaugauucugaagcuccugaccgacuuucaaccccaucagcuuugggcuacacugcucucccugaccuucaucaaaacaaccuuuagccugcacuaugccuggaagacgauggcuauggugcuuucuauugugucccuguucccucucugucugagcacaaccucucagaaaaccacauggcucccgguccugcuugggucccugggaugcaagccccugaccauguuucucaucgccgagaauaagauuuggggccgcagaagcuggccucugaacgaaggcaucauggcgguggggaucguuucuauucuucuguccagccuccugaaaaacgaugugccccucgccggaccucugaucgcuggcgggaugcuuauugccuguuacgucaucuccggaagcucugcugaccugagccuggagaaggccgccgagguguccugggaagaggaagcugagcauucuggcgcgagccacaauauucucguugaagugcaggaugacgggacaaugaaaaucaaggaugaggagcgggacgauacgcugaccauccuucugaaagccacacuccuggcugucuccggaguguauccccucucuauuccugccacccuguucgucugguacuucuggcaaaagaaaaagcagcgcagcggcgugcuuugggacacacccuccccgccugaaguugagagagccgugcuggaugacggcaucuaucggauuaugcagcgcgggcugcucggaagaucucaggucggcguggggguuuuucaagaaaacguguuccauaccauguggcacgucacgcggggagcugugcugauguaccagggcaagagacuugagcccagcugggccuccgugaaaaaggaccugaucagcuacgggggaggcuggcgccuccagggcucuuggaauaccggggaggaaguucaggucauugcgguggagccuggaaaaaaccccaagaaugugcaaacagcuccgggcaccuuuaaaacaccugaaggggaggucggagccaucgcccuggauuucaagcccggcaccuccgggagcccuauugugaaccgggaaggaaagaucguuggccucuauggcaaugggguggucacaacgucuggaaccuacguguccgcuaucgcccaggcgaaagcuagccaggagggcccccugcccgagauugaagacgagguuuuuagaaagcgcaaccuuacaaucauggaucugcacccuggguccggaaaaacccggagauaucugccggccauugugcgcgaagccaucaagcggaaacucagaacccugauucuugcucccacacgcgucguggccucugagauggcugaagcccugaagggcaugccuauccgguaccaaacgaccgcgguuaagagcgagcauacagggaaagagaucguggaccucaugugccacgccaccuucacaaugagacugcugucccccguccgggugccuaauuauaacaugauuaucauggaugaagcucauuuuaccgaccccagcucuauugccgcucgcggcuacaucuccacgagagugggaaugggcgaggccgccgcuauuuucaugacagcgaccccuccggggagcgucgaagccuuuccccagucuaaugcuguuauccaggaugaggaacgggacaucccugagcgcagcuggaacuccggauaugaguggauuaccgauuuccccggcaagacagugugguuugugccuucuaucaaaagcgggaaugacauugccaacugucucagaaagaauggaaaacgggucauccagcuuuccagaaagaccuucgauacagaauaccaaaagaccaaaaacaacgacugggacuacgugguuacgacagauauuucugagaugggcgccaauuuccgcgcugaccgggugaucgaucccagacgcugccugaagccggucauucugaaagacgggccugaacgggugauccucgccggccccaugcccguuaccguggcgagcgcugcccagagacgcggacggaucggcagaaaccacaauaaggagggggaucaguauauuuacaugggacagccucugaacaaugacgaggaucaugcccacuggacagaagcuaaaaugcuucuggacaacaucaauacccccgagggcauuaucccugcccucuuugaaccggagcgcgaaaaguccgcggccauugauggggaguauagacugcggggagaggcucgcaagacguucgucgaacugaugagacggggcgaccuccccguguggcuuagcuacaaagucgccucugagggguuucaauauuccgaucgcagauggugcuucgacggcgaacggaacaaucaggugcuggaggaaaacauggauguugagaucuggaccaaggagggagaaagaaaaaagcugcgcccucgguggcucgacgcuagaacauacagcgacccccuggcccuucgcgaguuuaaagaauucgcugccggccggagauccgugucuggggaucugauccucgagauuggaaagcugccucagcaccugacccagcgggcgcaaaaugcccucgacaaccuugugaugcugcauaauagcgaacagggcgggcgcgcuuauagacacgccauggaggagcugcccgauacaaucgaaacccucaugcugcuugcucugauugccguccucacaggaggcguuacccuguuuuuccuguccggccgggggcucggaaaaacgucuaucggccuucugugugugauggccagcuccgugcugcucuggauggcuagcgucgagccgcauuggauugcggccucuaucauccuggaauuuuuccuuauggugcugcucauuccugagcccgaccgccagagaacaccucaggauaaccaacuggcuuacguugugaucgggcugcucuuuaugauucuuaccgucgccgccaaugagaugggacugcuggaaaccacaaagaaggaccucggcaucgggcacguggcugucggaaaccaccaucacgccgcgaugcuggauguggaccuucaucccgccuccgcuuggacccuguacgccguugcuacaacgauuaucaccccuaugaugcggcacacaauugagaacaccacagccaauaucagccucaccgcgaucgccaaccaggcugccauucugaugggccuggauaaaggcuggcccaucucuaagauggacauuggggugccgcuccuugcucugggaugcuauucccaggucaauccucugacgcucaccgccgcugugcugaugcuuguugcccauuacgcgaucauuggccccgggcugcaagccaaagcuacacgcgaagcccagaagagaaccgcugccggaaucaugaaaaaccccacaguggauggcaucgucgccauugaccucgauccugugguguaugacgcgaaguucgagaagcagcuggggcagaucaugcugcucauucuuuguaccagccaaauccugcugaugcggacgacaugggcucucugcgaaucuauuacccuggccacaggaccgcuuaccacccugugggagggcagccccggcaaauuuuggaauacaacgaucgcuguuuccauggccaacaucuuccgcgggucuuaccucgccggagcuggccuggccuucagccugaugaagucccucgggggaggcagacgggggaccggagcgcagggcgagacacuuggcgaaaaauggaagagacagcugaaucagcugagcaaauccgaguuuaacaccuauaagcgcucugggauuauggaagucgaccggagcgaggccaaggaaggacucaaaagaggcgagaucacaaagcacgcugugucccgcgggaccgccaaacugcggugguucguggagagaaaucuugucaagccugaaggaaaaguuauugaucugggcugugggcgcggaggcuggucuuacuauugcgcuggccucaagaaggugacggaggugaaaggguacacaaagggaggccccgggcacgaagagccuauccccauggccaccuacggauggaaccuggucaaacugcauagcggcaaggacguguuuuucguuccuccggaaaaaugugauacccuccuuugcgacauuggggaguccucucccaauccuacaaucgaggaaggacggacccugagagugcugaagauggucgagcccuggcuccgcggcaaccaauuuuguauuaaaauccugaauccuuauaugcccagcgugguugaaacacuugagcagaugcagcggaagcacggcgggaugcuggugagaaacccgcucucccgcaauagcacgcaugagauguacugggucucuugcggaaccggcaacaucguguccgcggugaauaugacaagccggaugcugcugaacagauucaccauggcccaccgcaagccuacauaugaaagagaugucgaccucggggcuggaacccggcacguugccguggagcccgaaguggcuaaccuggauauuaucggccagcgcauugagaauaucaaacaugaacacaagucuacguggcauuacgacgaggauaaccccuauaaaaccugggccuaccacggguccuaugaggucaagccuagcggaucugcuuccagcauggugaauggcguugugaaacuucugacaaagcccugggacgucauuccuauggugacccaaaucgccaugacagauaccacaccguuuggccagcagagaguuuucaaggaaaaaguggacacccggacgcccaaggcgaaaagagggacagcccaaaucauggaggucaccgcuaaguggcucuggggauuucugucccggaacaaaaagccucgcauuuguaccagagaagaguucacacggaaggugcgcagcaaugccgcuaucggcgccguuuuuguggacgaaaaccaguggaauucugccaaagaggcggucgaggaugaaagauucugggaccuugugcaucgggagcgcgaacugcacaagcaggggaaaugcgcuacgugcgucuacaacaugaugggaaagagagagaaaaagcucggcgaauuugggaaggccaaaggcagccgggccauuugguacauguggcugggagcucgcuuccuggaguucgaggcccucggcuuuaugaaugaagaucacugguucuccagagagaacucucugagcgggguggaaggagagggccuucauaagcugggguauauccuccgggacauuuccaaaauccccggaggcaauauguacgcugaugacaccgccgggugggauacacgcaucaccgaggacgaucugcagaacgaagcgagaauuacagacaucauggagccugaacacgcccuucuggcuaagucuauuuuuaaacucaccuaucaaaauaagguugugcggguccagcgccccgccaaaaacggcacagugauggaugugaucagcagacgggaccagagaggauccggccagguugggaccuacggacugaauacguucaccaacauggaggcucaacugauucgccagauggaaucugagggcaucuuuagcccguccgagcucgaaacaccuaaccuggccgagcgggugcuugauuggcuggaaaaguauggggucgagagacucaagcgcauggcgaucagcggagacgacugugugguuaaacccauugaugaccgguucgccaccgcucugacagcccuuaaugauaugggcaaggugagaaaagacaucccucagugggaacccucuaagggguggaacgauuggcagcaagucccuuuuugcucccaucacuuccaccagcugauuaugaaagacggccgcgagaucgugguccccugucggaaucaggaugagcucgugggaagagcucgcguuagccagggcgccggguggucucugcgggaaaccgcuugccugggaaaguccuacgcccaaauguggcagcucauguauuuucauagacgcgaccugcggcuugcggccaacgcuauuuguagcgccgugccggucgauuggaucccuacguccagaacaaccuggucuauucacgcccaucaccaguggaugacaaccgaggacaugcugagcguguggaaucggguuuggaucgaagagaaccccuggauggaagauaagacgcauaucuccagcuggggcgacgugcccuaccucgggaaaagagaggaccaauggugcggaucucugauuggccuuaccgcucgcgccacaugggcgaccaauauccaggucgcuauuaaccaggugcggagacugaucgggaaugagaacuaccucgauuauaugacauccaugaagcgcuucaaaaaugaaagcgacccugagggcgcccugugguga

SEQ ID NO: 18569 - RNA, 9879 nt, Artificial Sequence
  derived and/or modified CDS sequence (opt5) from DENV-1__FJ639691__SS-prME
uccgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucuccgaagcugaacccgacgauguggacuguuggugcaaugccacagauaccugggugacguauggaaccuguucucaaacaggcgagcacagacgggacaagcgcagcguugcccucgcuccucauguggggcugggacuggagaccagaacagaaaccuggauguccucugagggcgccuggaaacagauucagcggguugaaacgugggcucuccgccaccccggcuuuacagugaucgcccuguuccuugcgcaugccauugggaccagcaucacacagaagggaaucauuuuuauccugcucaugcuggucaccccuuccauggcuaugagaugcgugggcauugggagccgggauuucguugagggacuuucuggcgccaccuggguggacgucgugcuggagcacggguccugugugacaacgauggcuaaggauaaacccacccucgacaucgaacugcugaagacagaggucaccaacccugccguucuccgcaaacugugcauugaagcgaagaucagcaauacaaccacggauucuagauguccgacacaaggagaggccacccuuguggaagaacaagacgcuaacuuugugugccggcgcaccuucgucgauagaggcuggggcaauggguguggacuguuuggcaaagggucccucauuacaugcgccaaguucaagugcgugaccaaacuggagggaaagaucguucaguacgaaaaccuuaaauauagcgugaucgucacagugcacacgggcgaccagcaucaaguugggaaugagucuaccgaacacggaacaaccgcuacaauuacaccccaggccccuuccacggagauccagcugaccgacuacggcgcccucacacuggauuguagcccccggaccggccuggacuuuaacgaaauggugcuccugacaaugaaggagaaauccuggcuuguccauaagcagugguuccuggaucucccucugcccuggaccucuggggcuagcacgucccaagagacauggaaucgccaggaccuucuggugaccuuuaaaacagcgcacgccaagaagcaggaagucgugguucucggaagccaagagggcgcuaugcacaccgcccugaccggggccacagaaauucagacgucuggaaccacaaccaucuucgcuggccaucugaaaugcagacucaagauggauaaacugacacuuaaggggauguccuaugugauguguaccggcagcuucaaacuggagaaggaagucgccgagacgcagcacggaacagugcucguucagauuaaguacgagggcaccgacgcgccgugcaaaaucccuuuuucuacccaagaugaaaagggggugacacagaacggacggcugaucaccgcuaaucccauugucacagacaaagagaagccugugaacaucgaagccgagccgcccuucggcgagagcuauauugugaucggggccggagaaaaagcucugaaacuuuccugguuuaagaaaggcucuagcauugggaagauguucgaggccacggcuagaggcgcccgccggauggcgauccucggagauaccgccugggacuuuggcuccaucgggggaguuuucacaagcgucggcaaacuggugcaucagauuuuugggaccgcuuacggagugcuguucucuggcgucuccuggacaaugaagaucgggauuggcgugcuccugaccuggcuuggacugaauagcagaucuacgucccucagcaugaccuguaucgccguuggccuggugacacuguaccuuggggucauggugcaggcugauuccggaugcguuauuaacuggaaaggccgcgaacucaagugugggucuggaaucuuugugaccaaugagguccacacauggaccgaacaauauaaguuccaggccgacagcccuaaacggcuguccgcggccauuggcaaggcuugggaggagggggugugcggcaucagaucugccacacgccuggaaaacaucauguggaaacagauuagcaacgagcucaaucauauccugcuugaaaacgacaugaaguuuaccguuguggucggagauguggcuggcauucuggcccaggggaaaaagaugauccggccgcaacccauggaguacaaauauuccuggaaaagcuggggaaaggccaagauuaucggcgcugacgugcagaauacgacauucaucauugaugggccuaacacccccgaauguccugacgaucagagagcguggaauaucugggaggucgaggacuacggauuuggcauuuucaccacaaacaucuggcucaagcugcgcgauucuuauacccagguuugcgaccaccggcugauguccgccgcuauuaaagauagcaaggccgugcacgccgacaugggcuacuggaucgaaucugagaaaaaugaaacguggaaacuugcuagagccuccuucaucgaggugaagacauguauuuggcccaaaagccauacccucuggucuaacgggguccuggaaagcgagaugaucauuccgaagaucuauggaggcccuauuucccaacacaauuaccgccccggguacuuuacacagaccgcgggaccuuggcaucugggcaaacucgagcuggauuucgaccuuugcgaagggacaaccgugguuguggaugagcacugcggaaaccggggccccagccugagaacgaccacagucaccggcaagaucauccacgaaugguguugccggucuuguacacucccuccccugcgcuuuaaaggggaggacggaugcugguauggcauggagauuagaccggugaaggaaaaggaggaaaaucugguuaaauccauggugagcgcuggguccggagaggucgacucuuucagccuuggccuccuguguaucuccauuaugaucgaagaggugaugcggucuagauggagccgcaagaugcugaugaccgggacgcucgccgucuuuuuccugcuuauuaugggacagcugacauggaacgaucucauccggcugugcauuauggugggcgccaaugcuuccgacagaaugggcauggggaugaccuaccuggcccuuauggcgacauuuaaaaugcgcccuauguucgcugucggacugcucuuuagacggcugaccucucgcgaggugcuccugcuuaccaucggccugagccucguggccuccgucgaacugcccaacagccuggaggaacuuggggauggacuggccaugggcaucaugauucucaagcugcucacagacuuccaaucuuaucagcugugggcuacgcuucugucccucaccuuuaucaaaacaaccuucagccugcauuacgccuggaagacaauggcuaugguucugucuauugugucccuuuuuccccugugucucagcaccacgucucagaagacaaccuggcugccugugcuccuggggucccuuggaugcaaaccgcugaccauguuccugaucgccgagaauaagauuuggggcagaaaaagcuggccccucaacgaaggcaucauggcggucgggaucguguccauucugcuuagcucucugcucaagaacgauguuccucuggccggaccccucaucgcuggcgggaugcugauugccuguuaugugaucagcggauccucugcugaccuuagccuggagaaagccgccgaggucuccugggaagaggaagcugagcacucuggcgcgagccauaauauucugguggaaguucaggaugacgggacaaugaagaucaaagaugaggagcgggacgauacccucacaauccugcuuaaggccacgcugcucgcuguguccggagucuacccucugucuauucccgccacccucuucgugugguauuuuuggcaaaagaaaaagcagcgcagcggcguccugugggacacaccuagcccucccgaaguggagagagccguucuugaugacggcaucuaccggauuaugcagcgcgggcugcugggaagaagccaggugggcgucgggguguuccaagaaaacguuuuucacaccauguggcaugugacacggggagcuguccucauguaccagggcaaacgccuggagcccucuugggccuccgugaagaaagaccuuaucagcuaugggggaggcuggagacugcagggcucuuggaauaccggggaggaagugcagguuauugcggucgagcccggaaagaacccuaagaaugugcaaacggcucccggcaccuucaaaacauccgaaggggaggugggagccaucgcccucgauuuuaagccgggcaccagcggguccccuauugucaaccgggaaggaaaaaucgugggccuguacggcaaugggguugugacaaccucuggaacauaugucagcgcuaucgcccaggcgaaggcuucccaggagggcccccucccugagauugaagacgagguguucagaaaacgcaaccugacgaucauggaucuucaccccgggagcggaaagacccggagauaccugcccgccauuguucgcgaagccaucaagcggaaacugagaacacucauucuggcuccuacccgcguggucgccucugagauggcugaagcccuuaagggcaugccgauccgguaucaaaccacagcggugaaauccgagcacacggggaaggagaucguugaccugaugugccaugccaccuuuacaaugagacuccugagccccgugcgcgucccuaauuacaacaugauuaucauggaugaagcucacuucaccgaccccucuagcauugccgcucggggcuauaucuccacaagagugggaaugggcgaggccgccgcuauuuuuaugaccgcgacgccucccgggucuguggaagccuucccucagagcaaugcugucauccaggaugaggaacgggacaucccggagcgcuccuggaacucuggauacgaguggauuacagauuuucccggcaaaaccguuugguucgugccuagcaucaaguccgggaaugacauugccaacugucugagaaagaauggaaaacgggugauccagcucagccgcaagaccuucgauacagaauaccagaagaccaagaacaacgacugggacuaugucgugacaaccgauauuucugagaugggcgccaauuuuagagcugaccggguuaucgaucccagacgcugccuuaaaccugugauucugaaggacgggcccgaacgggucauccuggccggcccgaugccugugacgguugcguccgcugcccagagacgcggacggaucggcagaaaccauaauaaggagggggaucaguacauuuauaugggacagccccucaacaaugacgaggaucacgcccauuggacagaagcuaaaaugcugcuugacaacaucaauacccccgagggcauuaucccugcccuguucgaacccgagcgcgaaaagagcgcggccauugauggggaguaccggcucagaggagaggcucgcaaaacauuuguggaacugaugagacggggcgaccugccugucuggcucuccuauaagguggccucugagggguuccaauacagcgaucgcagauggugcuuugacggcgaacggaacaaucagguccuugaggaaaacauggauguggagaucuggaccaaagagggagaacgcaagaaacugagaccgcgguggcuggacgcuagaacguauuccgacccccucgcccugcgcgaguucaaggaauuugcugccggccggagaucuguuagcggggaucuuauccuggagauuggaaagcucccucagcaccugacccagcgcgcgcaaaaugcccuggacaaccucgugaugcuucacaauuccgaacagggcgggcgggcuuacagacaugccauggaggagcugcccgauacaaucgaaacccugaugcuccuggcucuuauugccgugcugacaggaggcgucacccucuucuuucugagcggccgggggcugggaaaaacaucuaucggccuccuuuguguuauggccuccagcgugcugcuguggauggcuucuguggagccucacuggauugcggccuccaucauccucgaguucuuucugaugguccuucugauucccgagccggaccgccagagaaccccucaggauaaccaacucgcuuacgugguuaucgggcugcuguucaugauucucacgguggccgccaaugagaugggacuucuggaaacaaccaagaaagaccugggcaucgggcaugucgcuguggagaaccaccaccaugccgcgaugcucgaugucgaccugcaccccgccagcgcuuggacccuuuaugccguggcuacaaccauuaucacaccuaugaugcggcauacgauugaaaacaccacagccaauaucucucugaccgcgaucgccaaccaggcugccauucucaugggacuggauaagggcuggcccaucagcaaaauggacauuggcguuccucugcucgcucuugggugcuacucccaggugaauccccugacacugaccgccgcuguccucaugcugguggcccacuaugcgaucauuggaccgggccuucaagccaaggcuacgcgcgaggcccagaagagaaccgcugccgggaucaugaaaaacccuacaguugauggaaucguggccauugaccuggaucccgucguguacgacgcgaaguuugaaaaacagcucggccagaucaugcugcugauucucuguaccucucaaauccuucugaugcggacaaccugggcucugugcgagagcauuacgcucgccacagggccccugaccacacuuugggagggauccccuggcaaguucuggaauaccaccaucgcugugagcauggccaacaucuuccgcggcuccuaucuggccggggcuggacucgccuuuucucugaugaaaagccugggcgggggaagacggggcacaggggcgcagggagaaacgcucggcgagaaguggaagcgccagcuuaaucagcuguccaaaucugaguucaacaccuacaagagaagcggcauuauggagguugaccgguccgaagccaaagaggggcugaagagaggagagacaaccaaacaugcugucucucgcggcacagccaagcuccggugguuuguggaaagaaaucuggugaagccggaggggaaagucaucgaucuuggauguggccgcgggggauggagcuauuacugcgcuggccugaagaaaguuaccgaagugaagggcuacacgaaagggggacccggccacgaggaaccuauucccauggccacauauggguggaaccucgugaagcugcacuccggaaaagacgucuucuuugugccucccgagaagugugauacccugcucugcgacaucggcgagagcucuccuaauccgaccauugaagaggggcggacacuuagaguucugaagaugguggaacccuggcugcgcggaaaccaauucuguaucaaaauucucaauccuuacaugcccuccgucguggagacccuggagcagaugcagcggaagcauggcggcaugcuuguuagaaacccucugagccgcaauucuacacacgaaauguauuggguguccugcgggacgggaaacaucgucagcgcggugaauaugaccucucggaugcuccugaacagauuuacaauggcccaucgcaaacccaccuacgagcgggauguggaccugggcgcugggacaagacacgucgccguugaaccggagguggcuaaccucgauaucauuggacagcgcaucgaaaauauuaagcacgagcauaaauccaccuggcacuaugacgaggauaacccuuacaagacgugggccuaucauggcagcuacgaagugaagcccuccgggagcgcuucuagcauggucaauggagugguuaaacugcuuaccaagcccugggacgugaucccuauggucacacaaauugccaugaccgauacaacccccuucggccagcagagaguguuuaaagagaagguugacacacggaccccuaaagcgaagcgcggcacggcccaaaucauggaagugacagcuaaguggcuguggggguuccucuccagaaacaaaaagccgcggaucuguaccagagaggaauuuacccggaaaguccgcucuaaugccgcuauuggagccguguucguugacgagaaccaguggaauagcgccaaggaggcgguggaagaugagagauuuugggaccugguccaccgggaacgcgagcuucauaaacagggcaagugcgcuacaugcguguacaacaugauggggaagagagagaagaagcugggagaguucggcaaagccaaggggucccgggccaucugguauauguggcucggcgcucgcuuccuggaguuugaagcccugggauucaugaaugaggaucacugguuuucuagagaaaacagccucuccggcgucgagggggagggacugcacaaacuuggcuacauucugcgggacaucucuaagauuagcgggggaaauauguaugcugaugacacggccggcugggauacccgcaucacagaagacgaucuccagaacgaggcgaaaaucaccgacauuauggaacccgagcaugcccugcuugcuaaguccaucuucaagcugacauaccaaaauaaagugguuagagugcagcggccugccaagaacgggaccgucauggaugugauuagccgcagagaccagcggggcucuggacaggugggcacauaugggcucaauaccuuuacgaacauggaagcucaacugauccgccagauggaguccgagggaauuuucagccccucugaacuggagaccccuaaccucgccgaaagaacacuggauuggcuugagaaacacggcguugaacggcugaagagaauggcgaucuccggggacgacuguguggucaaacccaucgaugaccgcuuugccaccgcucucacagcccugaaugauaugggaaaggugcggaaggacauuccgcagugggagccuagcaaaggcuggaacgauuggcagcaaguucccuucugcucccaucacuuucaccagcuuaucaugaaggacgggagagagauuguggucccuugucgcaaucaggaugaacuggugggccgggcuagagucucucagggagccggcuggagccuccgcgagaccgcuugccuggggaaauccuacgcccaaauguggcagcugauguauuuccaucggagagaccuccgccuggcggccaacgcuaucuguagcgccgugcccguugauugggugccuacgucucggacaaccugguccauucacgcccaucaccaguggaugacaaccgaagacaugcuuagcgucuggaauagaguguggaucgaggaaaaccccuggauggaggauaagacgcauauuucuagcugggaggacguuccguaccugggaaaacgcgaagaccaauggugcggcucccucaucgggcugaccgcucgggccacaugggcgaccaauauccagguggcuauuaaccaggucagacggcuuaucggaaaugagaacuaccuggauuauaugacaucuaugaagagauuuaagaaugaaagcgaccucgagggcgcccugugguga

SEQ ID NO: 18570 - RNA, 9879 nt, Artificial Sequence
  derived and/or modified CDS sequence (opt5) from DENV-1__FJ639692__SS-prME
agcgugaccaugcugcucaugcugaugcccaccgcccuugcuuuccaccugacgaccagaggcggggagccucauaugaucgucuccaagcaggaacgggggaaaucucuccuguuuaagaccagcgccggcguuaauaugugcacccuuaucgcgauggaccugggggagcucugugaagauacgaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagucugccuggaaacagauucagcggguugaaacaugggcucugcgccaccccggcuucaccgugaucgcccuuuuucuggcgcaugccauuggcacaagcaucacccagaaggggaucauuuucauccuccugaugcuugucaccccuuccauggcuaugagaugcgugggaauuggcagccgggauuuuguugaggggcugucuggagccacauggguggacgucgugcucgagcacggcuccugugugacgaccauggcuaaggauaaacccacacuggacaucgaacugcucaagaccgaggucacaaacccugccauucugcgcaaacuuugcaucgaagcgaagauuagcaauaccacgacagauucuagauguccgacccaaggggaggccacccugguugaagaacaagacgcuaacuucgugugccggcgcacauuuguggauagaggauggggcaauggcuguggacucuucggaaaaggcucccugauuaccugcgccaaguuuaagugcgucacaaaacuugaggggaagaucgugcaguacgaaaaccugaaauauagcguuauugugacgguccacaccggagaccagcaucaagugggcaaugagucuacagaacacgggaccacagcuaccaucacgccccaggccccuaccacagagauucagcucaccgacuacggagcccugacacuggauuguagcccccggaccggccucgacuucaacgaaaugguucugcuuacgaugaaggagaaaagcuggcuggugcauaagcagugguuucucgaucugccucuucccuggacauccggcgcuucuaccagccaagagacauggaaucgccaggaccugcucgucaccuucaaaaccgcgcacgccaagaagcaggaaguggucgugcuggggucccaagagggagcuaugcacacagcccugacgggcgccaccgaaauccagacaagcgggaccacaaccauuuuugcuggacaucucaaaugcagacugaagauggauaaacuuacgcugaagggcaugucuuauguuauguguacaggguccuucaaacucgagaaggaaguggccgagacccagcacggcaccguccuggugcagaucaaguacgagggaacagacgcgccgugcaaaaucccuuucagcacccaagaugaaaagggcguuacacagaacgggcggcugauuacggcuaaucccaucgugaccgacaaagagaagccugucaacauugaagccgagccgcccuuuggagagucuuauaucgugauuggcgccggggaaaaagcucuuaagcucagcugguucaagaaaggauccucuaucggcaagauguuugaggccacagcuagaggggcccgccggauggcgauccugggcgauaccgccugggacuucggaagcauuggcgggguguuuacauccguuggaaaacugguccaucagaucuucggcaccgcuuacggggugcucuuuagcggagugucuuggacgaugaagauuggcaucgggguccugcuuaccuggcugggccucaauuccagaagcacaucucuguccaugaccuguauugccgugggacugguuacacuuuaccucggcgugaugguccaggcugauagcgggugcgugaucaacuggaaaggacgcgaacugaaguguggcuccgggauuuucguuaccaaugaggugcacacauggaccgaacaauauaaguuucaggccgacucuccuaaacggcugagcgcggccaucggaaaggcuugggaggagggcgucugcgggaucagauccgccacgcgccucgaaaacauuauguggaaacagaucucuaacgagcugaaucauauucuucuggaaaacgacaugaaguucacagugguugugggcgaugucgcuggaauccucgcccagggcaaaaagaugauucggccgcaacccauggaguacaaauauagcuggaaguccugggggaaggccaaaaucaucggagcugacgugcagaauaccaccuuuauuaucgauggcccuaacacacccgaauguccugacgaucagagagcguggaauauuugggagguggaggacuacggguucggaaucuuuaccacgaacauuuggcugaagcugcgcgauagcuauacacaggucugcgaccaccggcuuaugucugccgcuaucaaagauuccaaggccguucacgccgacaugggcuacuggaucgaaagcgagaaaaaugaaaccuggaagcucgcuagagccucuuucauugaggugaagacauguaucuggcccaaaucccauacccuguggagcaacggcgugcuggaaucugagaugauuaucccgaagauuuaugggggaccuaucagccaacacaauuaccgccccggcuacuucacacagaccgcggggccuuggcaucucggaaaacuggagcuugauuuugaccugugcgaaggcacgaccgucgugguugaugagcacugcgggaaccggggacccucccucagaacaaccacagugaccggcaagaucauucacgaaugguguugccggagcuguacgcugccuccccugcgcuucagaggcgaggacgggugcugguauggaauggagauccggccggucaaagaaaaggaggaaaaucuugugaagucuaugguuuccgcuggcagcggggagguggacuccuuuucucucggacugcuguguauuagcaucaugauugaagaggucaugagaucccgcuggucucggaaaaugcucaugacaggcacccuggccguguuccuucugcucaucauggggcagcugacauggaacgaucugauuagacuuugcaucaugguuggagccaaugcuagcgaccgcaugggcaugggcaccaccuaccuggcccucauggcgacauuuaagaugagaccuauguucgcuguggggcugcucuuucggcgccugacguccagagagguccuucugcucaccaucggacugucucugguggccagcguggaacuucccaacucccuggaggaacucggcgaugggcuggccaugggaauuaugauccucaaacugcuuacagacuuccaaagccaucagcugugggcuacccuccugucucugacauuuauuaagaccacguucucccuucacuaugccuggaaaacaauggcuaugguccugagcaucguuucucucuuuccccugugucucuccaccaccagccagaagacaaccuggcugccugugcuucugggcucucuggggugcaagccgcucacaauguuccugauugccgagaauaaaaucuggggacggcgcuccuggccccuuaacgaaggcaucauggcggugggcauugucagcauccugcucuccagccugcucaagaacgaugugccucuggccgggccccuuauugcuggaggcaugcugaucgccuguuacguuauuucugggagcuccgcugaccugucucucgagaaagccgccgaggugagcugggaagaggaagcugagcauuccggagcgucucacaauauccuggucgaagugcaggaugacggcacgaugaagaucaaagaugaggagagagacgauacccuuacaauucugcucaaggccacccugcucgcuguuagcgggguguauccucuguccauccccgccacacuuuuugucugguacuucuggcagaagaagaagcagcggucuggagugcugugggacaccccuuccccucccgaagucgagcgcgccgugcuggaugacggcauuuauagaaucaugcagcggggccuccuggggcgcucccagguuggagugggcgucuuccaagaaaacguguuucauacgauguggcacguuaccagaggggcugugcuuauguaccagggaaaacggcuggagcccagcugggccucugucaagaaagaccucauuuccuacggcgggggauggagacugcagggcagcuggaauacaggcgaggaagugcaagugaucgcgguugagcccgggaagaacccuaaaaauguccaaaccgcucccggaacauucaagaccccggaaggcgaggugggggccauugcccucgauuuuaagccuggaacaucuggcucccccaucgugaaccgcgaagggaaaaucgucggacuguauggcaauggcgugguuacgaccagcgggacauacguguccgcuauugcccaggcgaaggcuucucaggagggaccucuucccgagaucgaagacgaggucuuccggaaaagaaaccugaccauuauggaucugcaccccggcagcgggaagacccgccgguaucucccugccaucgugagagaagccauuaaacgcaagcugcggacacuuauccuggcuccgacgagaguuguggccuccgagauggcugaagcccucaagggaaugcccauccgcuaccaaaccacagcggucaaaagcgagcauaccggcaaggagauuguggaccugaugugccacgccacauuuaccaugcggcugcucucuccuguuagagugcccaauuauaacaugaucauuauggaugaagcucauuucacggacccuuccagcaucgccgcucggggguacauuucuacacgcgucggcaugggagaggccgccgcuaucuuuaugaccgcgacacccccuggcagcguggaagccuucccgcaguccaaugcucuuauccaggaugaggaaagagacauucccgagcggucuuggaacagcggguaugaguggaucacagauuuuccuggaaaaaccgugugguucguccccuccauuaagucuggcaaugacaucgccaacugucugcgcaaaaaugggaagagaguuauucagcugagccggaagacauuugauaccgaauaccagaaaacgaagaacaacgacugggacuacguggugacaaccgauaucuccgagaugggagccaauuucagagcugaccgcgucauugauccucggagaugccucaaacccgugauccugaaggacggcccggaacgcguuauccuugccgggccuaugcccgugacagucgcgagcgcugcccagcggagaggccgcauuggacggaaccacaauaaagagggcgaucaguauaucuacauggggcagccccugaacaaugacgaggaucaugcccacuggaccgaagcuaagaugcuccuggacaacauuaauacgccugagggaaucauucccgcccuguucgaaccugagagagaaaagucugcggccaucgauggcgaguaucgccucagaggggaggcucggaaaaccuuuguggaacuuaugcgcagaggagaccugccgguuuggcuguccuacaagguggccagcgagggcuuccaauauuccgaucggcgcuggugcuuugacggggaaagaaacaaucagguccucgaggaaaacauggauguggagaucuggacaaaagagggcgaacggaagaaacugagaccccgcuggcuugacgcucggaccuacucugacccucuggcccucagagaguucaaggaauuugcugccggacgccggagcgucuccggcgaucugauucuggagaucgggaaacucccccagcaccuuacacagagagcgcaaaaugcccuggacaaccuggugaugcuccauaauucugaacagggaggccgggcuuaucgccacgccauggaggagcugccugauaccauugaaacacuuaugcugcucgcucugaucgccguucugaccgggggagugacacucuucuuucuuagcggcagaggccuggggaagacauccauuggacugcucugugugauggccagcucuguccugcuuuggauggcuuccguugagccccauuggaucgcggccagcaucauucuggaguucuuucucauggugcugcugaucccggagccugaccggcagcgcacaccccaggauaaccaacucgcuuacguggucauuggccuucuguucaugauccugaccguggccgccaaugagauggggcuccuggaaacaaccaagaaagaccuuggaauuggccacguugcuguggggaaccaccaucacgccgcgaugcuggaugucgaccuccauccugccucugcuuggacacuguacgccguggcuacgaccaucauuacacccaugaugagacacaccaucgagaacacaaccgccaauaucucccugacggcgauugccaaccaggcugccauccucaugggacuugauaagggcuggccuauuagcaaaauggacaucggcgucccccugcuggcucucgggugcuauucucaggugaauccgcugacccuuacagccgcuguucugaugcucguggcccauuacgcgauuaucggaccuggccugcaagccaaggcuacccgggaagcccagaaacgcacagcugccgggaucaugaagaaccccaccgucgauggaauuguggccaucgaccuggaucccguuguguaugacgcgaaguuugagaaacagcucggccagauuaugcuucugauccuguguacgagccaaauucuccugaugagaacaaccugggcucuuugcgaauccaucacacuggccaccgggccucucaccacacugugggagggaucuccgggcaaguucuggaauacgaccaucgcugucagcauggccaacauuuuucggggcuccuaccuggccggggcuggacucgccuucagccuuaugaaaucccugggcgggggacgcagaggcacaggggcgcagggagagacccugggcgaaaaguggaaacggcagcucaaucagcugucuaagagcgaguucaacacauauaagagauccggcaucaccgaaguggaccgcucugaggccaaagaagggcuuaagcggggagagacgacaaaacacgcugugagcagaggcaccgccaagcugcgcugguuuguugagcggaaucucgucaaacccgaagggaaggugauugaucugggauguggcagagggggaugguccuacuauugcgcuggccugaagaaagugaccgaggucaagggcuacacaaaagggggaccuggccacgaagaacccaucccuauggccaccuacggguggaaccucguuaaacuucauucuggaaaagacguguucuuuauucccccugaaaagugugauacacugcugugcgacaucggcgagagcuccccgaaucccacgauugaggaagggcgcacccuccgggugcugaaaauggucgagccuuggcuuagaggaaaccaauucuguaucaagauccugaaucccuauaugccuagcgugguugaaacacucgagcagaugcagcgcaagcacggcggcaugcuggugcggaacccccugucuagaaauuccacccaugagauguacugggucagcugcgggacaggaaacauugugucugcgguuaauaugaccucccgcaugcuccugaaccgguuuacgauggcccacagaaaaccgaccuaugaacgcgauguggaccuuggcgcugggacaagacacgucgccguggagccugaaguggcuaaccuggauaucauuggacagcggaucgagaauauuaagcaugaacacaaaagcaccuggcauuacgacgaggauaaccccuauaagacaugggccuaccacggcucuuaugaggucaaacccuccgggagcgcuuccagcaugguuaauggaguggugaagcuccugaccaagccuugggacgucauccccauggugacacaaaucgccaugaccgauacgacaccuuucggccagcagcgcguuuuuaaagaaaagguggacaccagaaccccgaaagcgaagcggggcacagcccaaauuauggaggucacggcuaaauggcuuuggggguuccugucuagaaacaagaagccccggaucuguacccgcgaagaguuuacaagaaaagugcggagcaaugccgcuauuggagccguuuucguggacgaaaaccaguggaacuccgccaaggaggcggucgaggaugaacgcuuuugggaccucgugcauagagagcgggaacugcacaaacagggcaagugcgcuaccugcguuuacaacaugauggggaaacgcgagaagaagcugggagaguucggcaaagccaaggggucuagagccaucugguacauguggcucggcgcucgguuucuggaguucgaggcccuuggauucaugaaugaagaucacugguuuagccgcgagaacucccugucuggcguggaaggggagggacuccauaaacugggcuauauucuuagagacaucagcaagaucccugggggaaauauguacgcugaugacacagccggcugggauacccggauuacagaggacgaucugcagaacgaagcgcgcaucaccgacauuauggagcccgaacacgcccuccuggcuaaauccaucuucaagcugacguaucaaaauaaagucgugagaguccagcggccugccaagaacgggaccgugauggauguuauuucucgcagagaccagcggggcagcggacaggugggcacauacgggcucaauaccuuuacaaacauggaggcucaacugaucagacagauggaauccgagggaaucuucagccccucugagcuugaaaccccgaaccuggccgagcgcguccucgauuggcuggaaaaguauggcguggagcggcuuaaaagaauggcgauuuccggggacgacugugugguuaagccuaucgaugaccgcuuugccacggcucugacagcccucaaugauaugggaaaagugcggaaggacauuccccagugggaaccuagcaaaggcuggaacgauuggcagcaaguccccuucugcucucaucacuuucaccagcugaucaugaaggacgggagagagauugugguuccuugucgcaaucaggaugagcuggugggccgggcuagagucucccagggagccggcuggagccuccgcgaaaccgcuugccuggggaaguccuacgcccaaauguggcagcuuauguauuuccaucggagagaccugcgccucgcggccaacgcuaucuguucugccgugcccgucgauuggauuccgacaagccggaccacgugguccauccacgcccaucaccaguggaugaccacagaggacaugcugagcguguggaauagaguuuggaucgaagagaacccuuggauggaagauaaaacccauauuucuuccuggggagacgugcccuaccuuggcaagcgggaggaccaauggugcgggagccugaucggacucacagcuagagccaccugggcgacaaauauucaggucgcuaucaaccaggugcgccggcugauuggcaaugagaacuaccuggauuauaugaccucuaugaaaagauuuaagaaugaaagcgaccccgagggggcccucugguga

SEQ ID NO: 18571 - RNA, 9879 nt, Artificial Sequence
  derived and/or modified CDS sequence (opt5) from DENV-1__FJ639693__SS-prME
uccgugaccaugcugcucaugcugaugcccaccgcccuugcuuuccaccugacgaccagaggcggggaaccucauaugaucgucuccaagcaggaacggggaaagucucuccuguuuaagacaagcgccggcguuaacaugugcacccuuauugccauggaccugggggaguucugugaagauacaaugaccuacaagugcccgcgcaucuccgaagcugaacccgacgauguggacuguuggugcaaugccacagauaccugggugacguauggaaccuguucucaaacaggcgagcacagacgggacaagcgcagcguugcccucgcuccucauguggggcugggacuggagaccagaacagaaaccuggauguccucugagggcgccuggaaacagauucagcggguugaaacgugggcucuccgccaccccggcuuuacagugaucgcccuguuccuugcgcaugccauugggaccagcaucacacagaagggaaucauuuuuauccugcucaugcuggucaccccuuccauggcuaugagaugcgugggcauugggagccgggauuucguugagggacuuucuggcgccaccuggguggacgucgugcuggagcacggguccugugugacaacgauggcuaaggauaaacccacccucgacaucgaacugcugaagacagaggucaccaacccugccguucuccgcaaacugugcauugaagcgaagaucagcaauacaaccacggauucuagauguccgacacaaggagaggccacccuuguggaagaacaagacgcuaacuuugugugccggcgcaccuucgucgauagaggcuggggcaauggguguggacuguuuggcaaagggucccucauuacaugcgccaaguucaagugcgugaccaaacuggagggaaagaucguucaguacgaaaaccuuaaauauagcgugaucgucacagugcacacgggcgaccagcaucaaguugggaaugagucuaccgaacacggaacaaccgcuacaauuacaccccaggccccuuccacggagauccagcugaccgacuacggcgcccucacacuggauuguagcccccggaccggccuggacuuuaacgaaauggugcuccugacaaugaaggagaaauccuggcuuguccauaagcagugguuccuggaucucccucugcccuggaccucuggggcuagcacgucccaagagacauggaaucgccaggaccuucuggugaccuuuaaaacagcgcacgccaagaagcaggaagucgugguucucggaagccaagagggcgcuaugcacaccgcccugaccggggccacagaaauucagacgucuggaaccacaaccaucuucgcuggccaucugaaaugcagacucaagauggauaaacugacacuuaaggggauguccuaugugauguguaccggcagcuucaaacuggagaaggaagucgccgagacgcagcacggaacagugcucguucagauuaaguacgagggcaccgacgcgccgugcaaaaucccuuuuucuacccaagaugaaaagggggugacacagaacggacggcugaucaccgcuaaucccauugucacagacaaagagaagccugugaacaucgaagccgagccgcccuucggcgagagcuauauugugaucggggccggagaaaaagcucugaaacuuuccugguuuaagaaaggcucuagcauugggaagauguucgaggccacggcuagaggcgcccgccggauggcgauccucggagauaccgccugggacuuuggcuccaucgggggaguuuucacaagcgucggcaaacuggugcaucagauuuuugggaccgcuuacggagugcuguucucuggcgucuccuggacaaugaagaucgggauuggcgugcuccugaccuggcuuggacugaauagcagaucuacgucccucagcaugaccuguaucgccguuggccuggugacacuguaccuuggggucauggugcaggcugauuccggaugcguuauuaacuggaaaggccgcgaacucaagugugggucuggaaucuuugugaccaaugagguccacacauggaccgaacaauauaaguuccaggccgacagcccuaaacggcuguccgcggccauuggcaaggcuugggaggagggggugugcggcaucagaucugccacacgccuggaaaacaucauguggaaacagauuagcaacgagcucaaucauauccugcuugaaaacgacaugaaguuuaccguuguggucggagauguggcuggcauucuggcccaggggaaaaagaugauccggccgcaacccauggaguacaaauauuccuggaaaagcuggggaaaggccaagauuaucggcgcugacgugcagaauacgacauucaucauugaugggccuaacacccccgaauguccugacgaucagagagcguggaauaucugggaggucgaggacuacggauuuggcauuuucaccacaaacaucuggcucaagcugcgcgauucuuauacccagguuugcgaccaccggcugauguccgccgcuauuaaagauagcaaggccgugcacgccgacaugggcuacuggaucgaaucugagaaaaaugaaacguggaaacuugcuagagccuccuucaucgaggugaagacauguauuuggcccaaaagccauacccucuggucuaacgggguccuggaaagcgagaugaucauuccgaagaucuauggaggcccuauuucccaacacaauuaccgccccggguacuuuacacagaccgcgggaccuuggcaucugggcaaacucgagcuggauuucgaccuuugcgaagggacaaccgugguuguggaugagcacugcggaaaccggggccccagccugagaacgaccacagucaccggcaagaucauccacgaaugguguugccggucuuguacacucccuccccugcgcuuuaaaggggaggacggaugcugguauggcauggagauuagaccggugaaggaaaaggaggaaaaucugguuaaauccauggugagcgcuggguccggagaggucgacucuuucagccuuggccuccuguguaucuccauuaugaucgaagaggugaugcggucuagauggagccgcaagaugcugaugaccgggacgcucgccgucuuuuuccugcuuauuaugggacagcugacauggaacgaucucauccggcugugcauuauggugggcgccaaugcuuccgacagaaugggcauggggaugaccuaccuggcccuuauggcgacauuuaaaaugcgcccuauguucgcugucggacugcucuuuagacggcugaccucucgcgaggugcuccugcuuaccaucggccugagccucguggccuccgucgaacugcccaacagccuggaggaacuuggggauggacuggccaugggcaucaugauucucaagcugcucacagacuuccaaucucaucagcugugggcuacgcuucugucccucaccuuuaucaaaacaaccuucagccugcacuaugccuggaagacaauggcuaugguucugucuauugugucccuuuuuccccugugucucagcaccacgucucagaagacaaccuggcugccugugcuccuggggucccuuggaugcaaaccgcugaccauguuccugaucgccgagaauaagauuuggggcagaaaaagcuggccccucaacgaaggcaucauggcggucgggaucguguccauucugcuuagcucucugcucaagaacgauguuccucuggccggaccccucaucgcuggcgggaugcugauugccuguuacgugaucagcggauccucugcugaccuuagccuggagaaagccgccgaggucuccugggaagaggaagcugagcauucuggcgcgagccacaauauucugguggaaguucaggaugacgggacaaugaagaucaaagaugaggagcgggacgauacccucacaauccugcuuaaggccacgcugcucgcuguguccggagucuauccucugucuauucccgccacccucuucgugugguacuuuuggcaaaagaaaaagcagcgcagcggcguccugugggacacaccuagcccucccgaaguggagagagccguucuugaugacggcaucuaucggauuaugcagcgcgggcugcugggaagaagccaggugggcgucgggguguuccaagaaaacguuuuucauaccauguggcacgugacacggggagcuguccucauguaccagggcaaacgccuggagcccucuugggccuccgugaagaaagaccuuaucagcuacgggggaggcuggagacugcagggcucuuggaauaccggggaggaagugcagguuauugcggucgagcccggaaagaacccuaagaaugugcaaacggcucccggcaccuucaaaacauccgaaggggaggugggagccaucgcccucgauuuuaagccgggcaccagcggguccccuauugucaaccgggaaggaaaaaucgugggccuguauggcaaugggguugugacaaccucuggaacauacgucagcgcuaucgcccaggcgaaggcuucccaggagggcccccucccugagauugaagacgagguguucagaaaacgcaaccugacgaucauggaucuucaccccgggagcggaaagacccggagauaucugcccgccauuguucgcgaagccaucaagcggaaacugagaacacucauucuggcuccuacccgcguggucgccucugagauggcugaagcccuuaagggcaugccgauccgguaccaaaccacagcggugaaauccgagcauacggggaaggagaucguugaccugaugugccacgccaccuuuacaaugagacuccugagccccgugcgcgucccuaauuauaacaugauuaucauggaugaagcucauuucaccgaccccucuagcauugccgcucggggcuacaucuccacaagagugggaaugggcgaggccgccgcuauuuuuaugaccgcgacgccucccgggucugccgaggcuuucccucagagcaaugccgugauccaggaugaagaacgggacaucccggagcgcuccuggaacucuggauaugaguggauuacagauuuucccggcaaaaccgucugguucguuccuagcaucaaguccgggaaugacauugccaacugucugagaaagaauggaaaacgggugauccagcucagccgcaagaccuucgauacagaauaccagaagaccaagaacaacgacugggacuacguggucacaaccgauauuucugagaugggcgcuaauuuuagagccgaccgggugaucgaucccagacgcugccuuaaaccuguuauucugaaggacgggcccgaacgggugauccuggcgggcccgaugccugucacgguggcuuccgccgcccagagacgcggacggaucggcagaaaccacaauaaggagggggaucaguauauuuacaugggacagccccucaacaaugacgaggaucaugcucacuggacagaagccaaaaugcugcuugacaacaucaauacccccgagggcauuaucccugcgcuguucgaacccgagcgcgaaaagagcgccgcuauugauggggaguaucggcucagaggagaggcccgcaaaacauuuguugaacugaugagacggggcgaccugccuguguggcucuccuacaaggucgcuucugagggguuccaauauagcgaucgcagauggugcuuugacggcgaacggaacaaucaggugcuugaggaaaacauggaugucgagaucuggaccaaagagggagaacgcaagaaacugagaccgcgguggcuggacgccagaacguacuccgacccccucgcucugcgcgaguucaaggaauuugccgcgggccggagaucugugagcggggaucuuauccuggagauuggaaagcucccucagcaccugacccagcgcgcccaaaaugcucuggacaaccucguuaugcuucauaauuccgaacagggcgggcgggccuauagacacgcuauggaggagcugcccgauacaaucgaaacccugaugcuccuggcccuuauugccgugcugacaggaggcgugacccucuucuuucugagcggccgggggcugggaaaaacaucuaucggccuccuuugugucauggcuuccagcguucugcuguggauggcgucuguggagccucauuggauugccgcuuccaucauccucgaguucuuucugauggugcuucugauucccgagccggaccgccagagaaccccucaggauaaccaacucgccuacgucgugaucgggcugcuguucaugauucucacgguugccgcuaaugagaugggacuucuggaaacaaccaagaaagaccugggcaucgggcacguggccgucgagaaccaccaucacgcggccaugcucgauguggaccugcaucccgcuagcgccuggacccuuuacgcugucgccacaaccauuaucacaccuaugaugcggcacacgauugaaaacaccacagcgaauaucucucugaccgccaucgcuaaccaggccgcuauucucaugggacuggauaagggcuggcccaucagcaaaauggacauuggcgugccucugcucgcccuugggugcuauucccagguuaauccccugacacugaccgcugccgugcucaugcuggucgcgcauuacgccaucauuggaccgggccuucaagcuaaggccacgcgcgaggcucagaagagaaccgccgccgggaucaugaaaaacccuacaguggauggaaucguugcgauugaccuggaucccguggucuaugacgcuaaguuugaaaaacagcucggccagaucaugcugcugauucucuguaccucucaaauccuucugaugcggacaaccugggcccugugcgagagcauuacgcucgcugugggguuccagacaacccugugggagggaucccccggcaaguucuggaauacaaccaucgccgugagcauggccaacaucuuucgcggcuccuaccuugcuggggccggacuggcguucucucucaugaaaagccugggcgggggaagacggggcaccggggcccagggagaaacacugggcgagaaguggaagcgccagcucaaucaacuuuccaaaucugaauuuaacacguauaagagaagcggcauuauggagguugaccgguccgaagcuaaagaggggcugaagagaggagagaccacaaaacacgccgucucucgcggcaccgcuaagcugcggugguucguggaaagaaaucucgugaagccugaggggaaagucaucgaucugggauguggccgcgggggauggagcuacuauugcgccggccuuaagaaaguuacagaagugaagggcuacaccaaagggggaccgggccacgaggaacccauuccuauggcgacguacggguggaaccuggugaagcuccauuccggaaaagacgucuuuuucgugcccccugagaagugugauacacugcugugcgacaucggcgagagcucucccaauccuaccauugaagaggggcggacccucagaguucuuaagaugguggaaccguggcugcgcggaaaccaguuuuguaucaaaauucugaaucccuauaugccuuccgucguggagacacucgagcagaugcagcggaagcacggcggcaugcugguuagaaacccccuuagccgcaauucuacccaugaaauguacuggguguccugcgggacaggaaacaucgucagcgccgugaauaugacgucucggaugcugcucaacagauucaccauggcucaccgcaaaccuacauaugagcgggauguggaccugggcgccgggaccagacacgucgcuguugaacccgagguggccaaccuggauaucauuggacaacgcaucgaaaauauuaagcaugagcacaaauccacauggcauuacgacgaggauaacccguauaagaccugggcuuaccacggcagcuaugaagugaagccuuccgggagcgccucuagcauggucaauggagugguuaaacuccugacgaagcccugggacgugauccccauggucacccagauugcgaugacagauaccacaccuuuuggccagcaaagaguguucaaagagaagguugacacccggacacccaaagccaagcgcggcaccgcucagaucauggaagugacggccaaguggcuuuggggguuucuguccagaaacaaaaagccucggaucuguacaagagaggaguucacccggaaaguccgcucuaaugcugccauuggagccguguuuguugacgagaaccaguggaauagcgcgaaggaggcuguggaagaugagagauucugggaccucguccaucgggaacgcgagcugcacaaacagggcaagugcgcgaccugcguguacaacaugauggggaagagagagaagaaacuuggagaguucggcaaagccaaggggucccgggcuaucugguacauguggcugggcgcccgcuuucucgaguucgaagcucugggauuuaugaaugaggaucacugguucucuagagaaaacagccuguccggcgucgagggggagggacuccauaaacugggcuauauucuucgggacaucucuaagauuagcgggggaaauauguacgccgaugacacagcgggcugggauacgcgcaucaccgaagacgaucugcaaaacgaggccaaaaucacagacauuauggaaccggagcacgcucuccuggccaaguccaucuuuaaacuuaccuaucagaauaaagugguuagagugcagcggcccgcuaagaacgggacagucauggaugugauuagccgcagagaccagcggggcucuggacaagugggcaccuacgggcugaauacauucaccaacauggaagcccagcucauccgccagauggaguccgagggaauuuuuagcccuucugaacuggagacgcccaaccuggcggaaagagcccucgauuggcuggagaaacauggcguugaacggcuuaagagaauggcuaucuccggggacgacuguguggucaaaccuaucgaugaccgcuucgccaccgcucugacagcccucaaugauaugggaaaggugcggaaggacauuccccagugggagccgagcaaaggcuggaacgauuggcaacagguuccuuuuugcucccaccacuuccaucagcugaucaugaaggacgggagagagauugugguccccugucgcaaucaggaugaacuugugggccgggcuagagucucucaaggagccggcuggagccugcgcgagaccgcgugccucgggaaauccuaugcccagauguggcagcugauguacuuucaccggagagaccugcgccucgcugccaacgccaucuguagcgcuggaccuguggauuggguucccacaucucggaccacgugguccauucaugcccaccaucaauggaugacaaccgaagacaugcugagcguguggaauagagucuggaucgaggaaaacccuuggauggaggauaagacacacauuucuagcugggaggacgugcccuaucuuggcaaacgcgaagaccaguggugcgggucccugaucggacucaccgcgcgggcuacgugggccaccaauauccagguugccauuaaccaggugagacggcugaucggcaaugagaacuaccuugauuacaugacaucuaugaagagauucaagaaugaaagcgacccggagggggcucugugguga

SEQ ID NO: 18572 - RNA, 9879 nt, Artificial Sequence
  derived and/or modified CDS sequence (opt5) from DENV-1__FJ639694__SS-prME
agcgugaccaugcugcucaugcugaugcccaccgcccuugcuuuccaccugacgaccagaggaggggagccucauaugaucguguccaagcaggaacggggaaagucucuccuguuuaagacaagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaggacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccaccagcuucucuaugaccuguauugccgugggccugguuacacuguaccuuggggugaugguccaggcugauuccggaugcgugaucaacuggaaaggccgcgaacucaagugugggagcggaauuuuuguuaccaaugaggugcacacauggaccgaacaauauaaguuccaggccgacuccccuaaacggcugucugcggccaucggcaaggcuugggaggagggggucugcggcaucagaagcgccacgcgccuggaaaacauuauguggaaacagaucuccaacgagcucaaucauauucugcuugaaaacgacaugaaguuuacagugguugugggagaugucgcuggcauccuggcccaggggaaaaagaugauucggccgcaacccauggaguacaaauauucuuggagaagcuggggaaaggccaagaucaucggcgcugacgugcagaauaccaccuucauuaucgaugggccuaacacacccgaauguccugacgaucagcgcgcguggaauauuugggagguggaggacuacggauuuggcaucuucaccacgaacauuuggcucaaacugcgggauuccuauacacaggucugcgaccacagacugaugagcgccgcuaucaaggauucuaaagccguucacgccgacaugggcuacuggaucgaauccgagaagaaugaaaccuggaaacuugcucgcgccagcuucauugaggugaagacauguaucuggcccaagucucauacccucugguccaacggggugcuggaaagcgagaugauuaucccgaaaauuuauggaggcccuaucucucaacacaauuaccggcccggguacuuuacacagaccgcgggaccuuggcaucugggcaagcucgagcuggauuucgaccuuugcgaagggacgaccgucgugguugaugagcacugcggaaacagaggccccagccugcggacaaccacagugaccggcaaaaucauucacgaaugguguugccgcuccuguacgcucccuccccugagauuuagaggggaagacggaugcugguauggcauggagaucagaccggucaaggaaaaagaggaaaaucuggucaaaagcaugguuucugcuggguccggagagguggacagcuucucccuuggccuccuguguauuucuaucaugauugaagaggucaugcgcagccggugguccagaaagaugcugaugacagggacccucgccguguuucugcuucugaucaugggacagcucacauggaacgaucugauucgccugugcaucaugguuggcgccaaugcuucugacagaaugggcauggggaccaccuaccuugcccugauggcgacauucaaaaugcggccuauguuugcugugggacuccuguuccgcagacucacgagccgggagguccugcuucugaccaucggccucucccugguggccucuguggaacugcccaacagccuugaggaacugggggauggacucgccaugggcauuaugauccugaagcuccugacagacuuucaaucccaucagcuuugggcuacccugcucagccugacauucauuaaaaccacguuuucucugcacuaugccuggaagacaauggcuaugguccuuuccaucguuagccuguucccccucugucugucuaccaccucccagaaaacaaccuggcucccugugcugcuugggagccugggaugcaagccgcugacaauguuucucauugccgagaauaagaucuggggccgcagaucuuggccccugaacgaaggcaucauggcgguggggauugucuccauccuucugagcucccuccugaaaaacgaugugccucucgccggaccccugauugcuggcgggaugcuuaucgccuguuacguuauuagcggaucuagcgcugaccugucccuggagaaggccgccgaggugucuugggaagaggaagcugagcauagcggcgcgucccacaauauccucgucgaagugcaggaugacgggacgaugaaaaucaaggaugaggagcgggacgauacccugacaauucuucugaaagccacccuccuggcuguuucuggaguguauccucucagcauccccgccacacuguucgucugguacuucuggcaaaagaaaaagcagcgcuccggcgugcuuugggacaccccuucucccccggaagucgagagagccgugcuggaugacggcauuuaucggaucaugcagcgcgggcugcucggaagaagccagguuggcgugggggucuuucaagaaaacguguuccauacgauguggcacguuacccggggagcugugcugauguaccagggcaagagacuugagccuuccugggccagcgucaaaaaggaccugauuucuuacgggggaggcuggcgccuccagggcuccuggaauacaggggaggaaguccaggugaucgcgguugagcccggcaagaacccuaagaauguccaaaccgcucccggcacauuuaaaaccccggaaggggaggugggagccauugcccuggauuucaagccuggcacaagcgggucucccaucgugaaccgggaaggaaagaucgucggccucuauggcaauggggugguuacgaccuccggaacauacgugagcgcuauugcccaggcgaaggcuucccaggagggcccucugcccgagaucgaagacgaggucuuuagaaagcgcaaccuuaccauuauggaucugcaccccgggucuggaaaaacccggagauaucugccugccaucgugcgcgaagccauuaagcggaaacucagaacacugauccuugcuccgacgcgcguuguggccagcgagauggcugaagcccugaagggcaugcccauccgguaccaaaccacagcggucaaguccgagcauaccgggaaagagauuguggaccucaugugccacgccacauucaccaugagacugcugagcccuguucgggugcccaauuauaacaugaucauuauggaugaagcucauuuuacggacccuucuuccaucgccgcucgcggcuacauuagcacaagagucggaaugggcgaggccgccgcuaucuucaugaccgcgacacccccugggucuguggaagccuuuccgcagagcaaugcugugauccaggaugaggaacgggacauucccgagcgcuccuggaacucuggauaugaguggaucacagauuucccuggcaagaccgucugguuuguucccagcauuaaauccgggaaugacaucgccaacugucucagaaagaauggaaaacgggugauucagcuuucuagaaagacauucgauaccgaauaccaaaagacgaaaaacaacgacugggacuacguggucacaaccgauaucagcgagaugggcgccaauuuccgcgcugaccgggugauugauccuagacgcugccugaagcccguuauccugaaagacgggccggaacgggugauccucgccggcccuaugcccgucacaguggcguccgcugcccagagacgcggacggauuggcagaaaccacaauaaggagggggaucaguauaucuacaugggacagccccugaacaaugacgaggaucaugcccacuggaccgaagcuaaaaugcuucuggacaacauuaauacgccugagggcaucauucccgcccucuuugaaccugagcgcgaaaagagcgcggccaucgauggggaguauagacugcggggagaggcucgcaagaccuucguugaacugaugagacggggcgaccucccgguguggcuuucuuacaaagucgccuccgagggguuucaauauagcgaucgcagauggugcuucgacggcgaacggaacaaucaggugcuggaggaaaacauggaugucgagaucuggacaaaggagggagaaagaaagaaacugcgcccccgguggcucgacgcuagaaccuacuccgacccucuggcccuucgcgaguuuaaagaguucgcugccggccggagaucugugagcggggaucugauucucgagaucggaaaacugccccagcaccugacacagcgggcgcaaaaugcccucgacaaccuuguuaugcugcauaauuccgaacagggcgggcgcgcuuauagacacgccauggaggagcugccugauaccauugaaacacucaugcugcuugcucugaucgccgugcucaccggaggcgugacgcuguuuuuccugucuggccgggggcucggaaaaacaagcauuggccuucugugugucauggccuccagcguucugcucuggauggcuucuguggagccccauuggaucgcggccuccaucauucuggaauuuuuccuuauggugcugcucaucccggagccugaccgccagagaacaccccaggauaaccaacuggcuuacgucgugauugggcugcucuuuaugauccuuaccguugccgccaaugagaugggacugcuggaaacaaccaagaaggaccucggcauugggcacguggcugucggaaaccaccaucacgccgcgaugcuggauguggaccuucauccugccagcgcuuggacacuguacgccgucgcuacgaccaucauuacacccaugaugcggcacaccaucgagaacacaaccgccaauaucucucucacggcgauugccaaccaggcugccauccugaugggccuggauaaaggcuggccuauuuccaagauggacaucggggugccccuccuugcucugggaugcuauagccagguuaauccgcugacccucacagccgcugugcugaugcuugucgcccauuacgcgauuaucggcccugggcugcaagccaaagcuacccgcgaagcccagaagagaacagcugccggaaucaugaaaaaccccaccguggauggcauuguugccaucgaccucgaucccguggucuaugacgcgaaguucgagaagcagcuggggcagauuaugcugcucauccuuuguacgucucaaauucugcugaugcggacaaccugggcucucugcgaaagcaucacacuggccaccggaccucuuaccacacugugggagggcuccccgggcaaauuuuggaauacgaccaucgcugugucuauggccaacauuuuccgcgggagcuaccucgccggagcuggccuggccuucucccugaugaaaagccucgggggaggcagacgggggacaggagcgcagggcgagacccuuggcgaaaaauggaagagacagcugaaucagcuguccaaaucugaguuuaacacauauaagcgcagcgggaucauggaaguggaccgguccgaggccaaggaaggacucaaaagaggcgagauuaccaagcacgcuguuucucgcgggacggccaaacugcggugguucgucgagagaaaucuugugaagcccgaaggaaaagugaucgaucugggcugugggcgcggaggcuggagcuacuauugcgcuggccucaagaaggucacagagguuaaaggguacaccaagggaggcccugggcacgaggagcccauuccuauggccaccuacggauggaaccuggugaaacugcauuccggcaaggacguguuuuucgugcccccugaaaaaugugauacacuccuuugcgacaucggggagucuagcccgaaucccaccauugaggaaggacggacacugagagugcugaagaugguugagccuuggcuccgcggcaaccaauuuuguaucaaaauccugaaucccuauaugccuuccguggucgaaacgcuugagcagaugcagcggaagcacggcgggaugcuggugagaaacccccucagccgcaauucuacccaugagauguacuggguuuccugcggaacaggcaacauugugagcgcggucaauaugaccucucggaugcugcugaacagauucacaauggcccaccgcaagccgaccuaugaaagagauguggaccucggggcuggaacgcggcacguggccgucgagccugaaguugcuaaccuggauaucauuggccagcgcaucgagaauauuaaacaugaacacaaguccaccuggcauuacgacgaggauaaccccuauaaaacaugggccuaccacgggagcuaugaggugaagcccucuggauccgcuagcuccauggugaauggcgucgugaaacuucugaccaagccuugggacguuauccccauggugacacaaaucgccaugaccgauacaaccccuuuuggccagcagagagucuucaaggaaaaaguggacacgcggacaccgaaggcgaaaagagggaccgcccaaauuauggagguuaccgcuaaguggcucuggggauuucugagccggaacaaaaagccccgcaucuguacaagagaagaguucacgcggaaggugcgcucuaaugccgcuauuggcgccgucuuuguggacgaaaaccaguggaauagcgccaaagaggcgguugaggaugaaagauucugggaccuugugcaucgggagcgcgaacugcacaagcaggggaaaugcgcuaccugcgucuacaacaugaugggaaagagagagaaaaagcucggcgaauuugggaaggccaaaggcucccgggccaucugguacauguggcugggagcucgcuuccuggaguucgaggcccucggcuuuaugaaugaagaucacugguucucuagagagaacagccuguccgggguggaaggagagggccuucauaagcugggguauauucuccgggacaucucuaaaaucccuggaggcaauauguacgcugaugacacagccgggugggauacccgcauuacagaggacgaucugcagaacgaagcgagaaucaccgacauuauggagcccgaacacgcccuucuggcuaagagcaucuuuaaacucacauaucaaaauaaggucgugcggguucagcgcccugccaaaaacggcaccgugauggaugucauuuccagacgggaccagagaggaucuggccagguggggacguacggacugaauaccuucacaaacauggaggcucaacugauccgccagauggaaagcgagggcaucuuuucccccagcgagcucgaaaccccgaaccuggccgagcgggugcuugauuggcuggaaaaguaugggguugagagacucaagcgcauggcgauuucuggagacgacuguguggucaaaccuaucgaugaccgguucgccacagcucugaccgcccuuaaugauaugggcaaggugagaaaagacauuccccagugggaaccuuccaagggguggaacgauuggcagcaaguucccuuuugcagccaucacuuccaccagcugaucaugaaagacggccgcgagauuguggucccuugucggaaucaggaugagcucgugggacgggcucgcgucucucagggcgccggguggucccugcgggaaacggcuugccugggaaagagcuacgcccaaauguggcagcucauguauuuucauagacgcgaccugcggcuugcggccaacgcuaucuguuccgccgugcccguugauuggauuccgacaucuagaaccacauggagcauccacgcccaucaccaguggaugaccacggaggacaugcuguccguguggaaucgggucuggaucgaagagaacccuuggauggaagauaagacccauauuagcaauuggggcgacgugcccuaccucgggaaaagagaggaccaauggugcggaucucugaucggccuuacagcucgcgccaccugggcgacaaacauucagguugcuaucaaucaggugcggagacugauugggaacgagaauuaccucgauuauaugaccuccaugaagcgcuucaaaaacgaaagcgaccccgagggcgcccugugguga

SEQ ID NO: 18573 - RNA, 9879 nt, Artificial Sequence
  derived and/or modified CDS sequence (opt5) from DENV-1__FJ639695__SS-prME
agcgugaccaugcugcugaugcugaugcccaccgcccuugcuuuccaccugacgaccagaggcggggagccucauaugaucguguccaagcaggaacggggaaagucucuccuguuuaagaccagcgccggcguuaacaugugcacccuuauugcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaggaacaagacgcuaacuucgugugccggcgcacauuuguggauagaggcuggggcaauggguguggacucuucggcaaagggucucugaugaccugcgccaaguuuaagugcgucacaaaacuugagggaaagaucgugcaguacgaaaaccugaaauauuccguuaucgugacgguccacaccggcgaccagcaucaaguggggaaugagagcacagaacacggaaccacagcuaccauuacgccccaggccccuaccacagagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggcugggcguccuucugaccuggcucggacucaauucuagauccacaagccugucuaugaccuguauugccgugggccuuguuacacucuaccugggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcucucugcggccaucggcaaggcuugggaggagggggucugcggcauuagaagcgccacgcgccuggaaaacaucauguggaaacagaucuccaacgagcuuaaucauauucugcucgaaaacgacaugaaguucacagugguugugggagaugucgcuggcauccuggcccaggggaaaaagaugauucggccgcaacccauggaguacaaauauucuuggaaaagcuggggaaaggccaagaucauuggcgcugacgugcagaauaccaccuuuaucaucgaugggccuaacacacccgaauguccugacgaucagagagcguggaauauuugggagguggaggacuacggauucggcaucuuuaccacgaacauuuggcugaaacuucgcgauuccuauacacaggucugcgaccaccggcucaugagcgccgcuaucaaagauucuaaggccguucacgccgacaugggcuacuggauugaauccgagaaaaaugaaaccuggaagcuggcuagagccagcuucaucgaggugaagacauguaucuggcccaaaucucauacccugugguccaacggggugcucgaaagcgagaugauuaucccgaagauuuauggaggcccuaucucucaacacaauuaccgccccggguacuucacacagaccgcgggaccuuggcaucugggcaaacuugagcuggauuuugaccucugcgaagggacgaccgucgugguugaugagcacugcggaaaccggggccccagccugagaacaaccacagugaccggcaagauuauccacgaaugguguugccgguccuguacgcugccuccccuucgcuucagaggggaggacggaugcugguauggcauggagauccggccggucaaagaaaaggaggaaaaucucgucaagagcaugguuucugcuggguccggagagguggacagcuuuucccugggccugcucuguauuucuaucaugauugaagaggucaugagaagccgcuggucccggaaaaugcugaugacagggacccuugccguguuccugcuccugaucaugggacagcugacauggaacgaucuuauuagacugugcaucaugguuggcgccaaugcuucugaccgcaugggcauggggaccaccuaccucgcccugauggcgacauuuaagaugagaccuauguucgcugugggacuccuguuucggcgccuuacgagcagagagguccugcuccugaccauuggccugucccuuguggccucuguggaacugcccaacagccucgaggaacugggggauggacucgccaugggcaucaugauccugaaacuucugacagacuuccaaucccaucagcucugggcuacccugcugagccuuacauuuauuaagaccacguucucucugcacuaugccuggaaaacaauggcuaugguccucuccaucguuagccuguuuccccucugucugucuaccaccucccagaagacaaccuggcuuccugugcugcuggggagccucggaugcaagccgcugacaauguuccuuauugccgagaauaaaaucuggggccggcgcucuuggccccugaacgaaggcauuauggcgguggggaucgucuccauccuccugagcucccuccugaagaacgaugugccucuugccggaccccugauugcuggcgggaugcugaucgccuguuacguuauuagcggaucuagcgcugaccucucccuggagaaagccgccgaggugucuugggaagaggaagcugagcauagcggcgcgucccacaauauccuugucgaagugcaggaugacgggacgaugaagauuaaagaugaggagagagacgauacccugacaauccuccugaaggccacccuccuggcuguuucuggaguguauccucuuagcauccccgccacacuguuugucugguacuucuggcagaagaagaagcagcgguccggcgugcugugggacaccccuucucccccggaagucgagcgcgccgugcucgaugacggcauuuauagaaucaugcagcgggggcugcuuggacgcagccagguuggcgugggggucuuccaagaaaacguguuucauacgauguggcacguuaccagaggagcugugcugauguaccagggcaaacggcucgagccuuccugggccagcgucaagaaagaccugauuucuuacgggggaggcuggagacuccagggcuccuggaauacaggggaggaagugcaagugaucgcgguugagcccggaaagaacccuaaaaauguccaaaccgcucccggcacauucaagaccccggaaggggaggugggagccauugcccuggauuuuaagccuggcacaagcgggucucccaucgugaaccgcgaaggaaaaauugucggccuuuauggcaauggggugguuacgaccuccggaacauacgugagcgcuaucgcccaggcgaaggcuucccaggagggcccucugcccgagaucgaagacgaggucuuccggaaaagaaaccugaccauuauggaucuccaccccgggucuggaaagacccgccgguaucugccugccaucgugagagaagccauuaaacgcaaacuucggacacugauccucgcuccgacgagaguuguggccagcgagauggcugaagcccugaagggcaugcccauucgcuaccaaaccacagcggucaaauccgagcauaccgggaaggagaucguggaccugaugugccacgccacauuuaccaugcggcuccuuagcccuguuagagugcccaauuauaacaugaucauuauggaugaagcucauuucacggacccuucuuccaucgccgcucggggcuacauuagcacacgcgucggaaugggcgaggccgccgcuaucuuuaugaccgcgacacccccugggucuguggaagccuucccgcagagcaaugcugugauucaggaugaggaaagagacauccccgagcgguccuggaacucuggauaugaguggaucacagauuuuccuggcaaaaccgucugguucguucccagcauuaaguccgggaaugacaucgccaacugucugcgcaaaaauggaaagagagugauucagcugucucggaagacauuugauaccgaauaccagaagacgaagaacaacgacugggacuacguggucacaaccgauaucagcgagaugggcgccaauuucagagcugaccgcgugauugauccucggagaugccucaaacccguuauccugaaggacgggccggaacgcgugauucuugccggcccuaugcccgucacaguggcguccgcugcccagcggagaggacgcaucggccggagccacaacaaagagggggaucaguauaucuacaugggacagccccugaauaacgacgaggaucaugcccacuggaccgaagcuaagaugcuccuggacaauauuaacacgccugagggcaucauucccgcccuguucgaaccugagagagaaaagucugcggccaucgauggggaguaucgccucagaggagaggcucggaaaaccuuuguugaacuuaugcgcagaggcgaccugccgguguggcuguccuacaaggucgccagcgagggguuccaauauuccgaucggcgcuggugcuuugacggcgaaagaaauaaccaggugcucgaggaaaauauggaugucgagauuuggacaaaagagggagaacggaagaaacugagaccccgcuggcuugacgcucggaccuacucugacccucuggcccucagagaguucaaggaauuugcugccggccgccggagcguguccggggaucugauccuggagaucggaaaacucccccagcaccuuacacagagagcgcaaaacgcccuggacaaucugguuaugcuccauaacucugaacagggcgggcgggcuuaucgccacgccauggaggagcugccugauaccauugaaacacuuaugcugcucgcucugaucgccgugcugaccggaggcgugacgcuguucuuucuuagcggcagagggcugggaaagacauccauuggccugcucugugucauggccagcucuguucugcuuuggauggcuuccguggagccccauuggaucgcggccagcauuauccuggaguucuuucucauggugcugcugaucccggagccugaccggcagcgcacaccccaggauaaucaacucgcuuacgucgugauugggcuucuguucaugauccugaccguugccgccaacgagaugggacuccuggaaacaaccaagaaagaccuuggcauugggcacguggcugucggaaaucaccaucacgccgcgaugcuggauguggaccuccauccugccucugcuuggacacuguacgccgucgcuacgaccaucauuacacccaugaugagacacaccaucgagaacacaaccgccaacauuucccugacggcgaucgccaaucaggcugccauccucaugggccuugauaagggcuggccuauuagcaaaauggacaucggggugccccugcuggcucucggaugcuauucucagguuaacccgcugacccuuacagccgcugugcugaugcucgucgcccauuacgcgauuaucggcccugggcugcaagccaaggcuacccgggaagcccagaaacgcacagcugccggaauuaugaagaaucccaccguggauggcaucguugccaucgaccuggaucccguggucuaugacgcgaaguuugagaaacagcucgggcagauuaugcuucugauccuguguacgagccaaauucuccugaugagaacaaccugggcucuuugcgaauccaucacacuggccaccggaccucucaccacacugugggagggcucuccgggcaaguucuggaacacgaccauugcugugagcauggccaauaucuuucggggguccuaccuggccggagcuggccucgccuucagccuuaugaaaucccucgggggaggccgcagagggacaggagcgcagggcgagacccugggcgaaaaguggaaacggcagcucaaccagcugucuaagagcgaguucaauacauauaagagauccgggaucauggaaguggaccgcucugaggccaaagaaggacuuaagcggggcgagaccacgaaacacgcuguuagcagagggacagccaagcugcgcugguuugucgagcggaaccucgugaaacccgaaggaaaggugauugaucugggcugugggagaggaggcugguccuacuauugcgcuggccugaagaaagucaccgagguuaagggguacaccaaaggaggcccugggcacgaagaacccaucccuauggccacauacggauggaaucucgugaaacuucauucuggcaaagacguguucuuuauucccccugaaaagugugauacccugcugugcgacaucggggagagcuccccgaaccccacaauugaggaaggacgcacgcuccggguccugaaaaugguggagccuuggcuuagaggcaaucaauucuguaucaagauucugaaccccuauaugccuagcguuguggaaacccucgagcagaugcagcgcaagcacggcgggaugcugguccggaauccccugucuagaaacuccacacaugagauguacugggugagcugcggaaccggcaauaucguuucugcggugaacaugacaucccgcaugcuccugaaucgguuuaccauggcccacagaaaaccgacguaugaacgcgaugucgaccuuggggcuggaaccagacacguggccguggagccugaagucgcuaaccuggauaucauuggccagcggaucgagaacauuaagcaugaacacaaaagcacauggcauuacgacgaggauaaucccuauaagaccugggccuaccacgggucuuaugagguuaaacccuccggaagcgcuuccagcauggugaacggcguggucaagcuccugacaaagccuugggacgugauccccaugguuacccaaauugccaugacagauaccacgccuuucggccagcagcgcguguuuaaagaaaaggucgacacaagaaccccgaaagcgaagcgggggaccgcccaaaucauggaggugacagcuaaauggcuuuggggauuccugucuagaaauaagaagccccggaucuguacgcgcgaagaguuuaccagaaaaguucggagcaacgccgcuauuggcgccguguucgucgacgaaaaucaguggaacuccgccaaggaggcgguggaggaugaacgcuuuugggaccucguucauagagagcgggaacugcacaaacaggggaagugcgcuacaugcguguacaauaugaugggaaaacgcgagaagaagcugggcgaguucgggaaagccaagggcucuagagccaucugguacauguggcucggagcucgguuucuggaguucgaggcccuuggcuucaugaacgaagaucacugguuuagccgcgaaaauucccugucuggggucgaaggagagggccuccauaaacugggguauauucuuagagacaucagcaagauuccuggaggcaacauguacgcugaugacaccgccgggugggauacacggaucaccgaggacgaucugcagaaugaagcgcgcaucacagacauuauggagcccgaacacgcccuccuggcuaaauccaucuucaagcugaccuaucaaaacaaaguggucagagugcagcggccugccaagaauggcacgguuauggaugugauuucucgcagagaccagcggggaagcggccaggucgggaccuacggacucaacacauuuaccaauauggaggcucaacugaucagacagauggaauccgagggcauuuucagccccucugagcuugaaacaccgaaccuggccgagcgcgugcucguguggcuggaaaaguaugggguugagcggcuuaaaagaauggcgaucuccggagaugacuguguggucaagccuaucgacgaucgcuuugccaccgcucugacggcccucaacgacaugggcaaagugcggaaggauauuccccagugggaaccuagcaaaggguggaaugacuggcagcaaguucccuucugcucucaucacuuucaccagcugaucaugaaggauggcagagagauuguggucccuugucgcaaccaggacgagcuggugggacgggcuagagucucccagggcgccggguggagccuccgcgaaacagcuugccugggaaaguccuacgcccaaauguggcagcuuauguauuuccaucggagagaucugcgccucgcggccaaugcuaucuguucugccgugcccguugacuggauuccgaccagccggacaaccugguccauccacgcccaucaccaguggaugacgaccgaggauaugcugagcguguggaacagagucuggauugaagagaauccuuggauggaagacaaaacacauaucucuuccuggggcgaugugcccuaccuugggaagcgggaggaccaauggugcggaagccugaucggccucaccgcuagagccacaugggcgaccaacauucagguugcuaucaaucaggugcgccggcugauugggaacgagaauuaccuggacuauaugacaucuaugaaaagauuuaagaacgaaagcgaucccgagggcgcccucugguga

SEQ ID NO: 18574 - RNA, 9879 nt, Artificial Sequence
  derived and/or modified CDS sequence (opt5) from DENV-1__FJ639696__SS-prME
uccgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucuccgaagcugaacccgacgauguggacuguuggugcaaugccacagauaccugggugacguauggaaccuguucucaaacaggcgagcacagacgggacaagcgcagcguugcccucgcuccucauguggggcugggacuggagaccagaacagaaaccuggauguccucugagggcgccuggaaacagauucagcggguugaaacgugggcucuccgccaccccggcuuuacagugaucgcccuguuccuugcgcaugccauugggaccagcaucacacagaagggaaucauuuuuauccugcucaugcuggucaccccuuccauggcuaugagaugcgugggcauugggagccgggauuucguugagggacuuucuggcgccaccuggguggacgucgugcuggagcacggguccugugugacaacgauggcuaaggauaaacccacccucgacaucgaacugcugaagacagaggucaccaacccugccguucuccgcaaacugugcauugaagcgaagaucagcaauacaaccacggauucuagauguccgacacaaggagaggccacccuuguggaagaacaagacgcuaacuuugugugccggcgcaccuucgucgauagaggcuggggcaauggguguggacuguuuggcaaagggucccucauuacaugcgccaaguucaagugcgugaccaaacuggagggaaagaucguucaguacgaaaaccuuaaauauagcgugaucgucacagugcacacgggcgaccagcaucaaguugggaaugagucuaccgaacacggaacaaccgcuacaauuacaccccaggccccuuccacggagauccagcugaccgacuacggcgcccucacacuggauuguagcccccggaccggccuggacuuuaacgaaauggugcuccugacaaugaaggagaaauccuggcuuguccauaagcagugguuccuggaucucccucugcccuggaccucuggggcuagcacgucccaagagacauggaaucgccaggaccuucuggugaccuuuaaaacagcgcacgccaagaagcaggaagucgugguucucggaagccaagagggcgcuaugcacaccgcccugaccggggccacagaaauucagacgucuggaaccacaaccaucuucgcuggccaucugaaaugcagacucaagauggauaaacugacacuuaaggggauguccuaugugauguguaccggcagcuucaaacuggagaaggaagucgccgagacgcagcacggaacagugcucguucagauuaaguacgagggcaccgacgcgccgugcaaaaucccuuuuucuacccaagaugaaaagggggugacacagaacggacggcugaucaccgcuaaucccauugucacagacaaagagaagccugugaacaucgaagccgagccgcccuucggcgagagcuauauugugaucggggccggagaaaaagcucugaaacuuuccugguuuaagaaaggcucuagcauugggaagauguucgaggccacggcuagaggcgcccgccggauggcgauccucggagauaccgccugggacuuuggcuccaucgggggaguuuucacaagcgucggcaaacuggugcaucagauuuuugggaccgcuuacggagugcuguucucuggcgucuccuggacaaugaagaucgggauuggcgugcuccugaccuggcuuggacugaauagcagaucuacgucccucagcaugaccuguaucgccguuggccuggugacacuguaccuuggggucauggugcaggcugauuccggaugcguuauuaacuggaaaggccgcgaacucaagugugggucuggaaucuuugugaccaaugagguccacacauggaccgaacaauauaaguuccaggccgacagcccuaaacggcuguccgcggccauuggcaaggcuugggaggagggggugugcggcaucagaucugccacacgccuggaaaacaucauguggaaacagauuagcaacgagcucaaucauauccugcuugaaaacgacaugaaguuuaccguuguggucggagauguggcuggcauucuggcccaggggaaaaagaugauccggccgcaacccauggaguacaaauauuccuggaaaagcuggggaaaggccaagauuaucggcgcugacgugcagaauacgacauucaucauugaugggccuaacacccccgaauguccugacgaucagagagcguggaauaucugggaggucgaggacuacggauuuggcauuuucaccacaaacaucuggcucaagcugcgcgauucuuauacccagguuugcgaccaccggcugauguccgccgcuauuaaagauagcaaggccgugcacgccgacaugggcuacuggaucgaaucugagaaaaaugaaacguggaaacuugcuagagccuccuucaucgaggugaagacauguauuuggcccaaaagccauacccucuggucuaacgggguccuggaaagcgagaugaucauuccgaagaucuauggaggcccuauuucccaacacaauuaccgccccggguacuuuacacagaccgcgggaccuuggcaucugggcaaacucgagcuggauuucgaccuuugcgaagggacaaccgugguuguggaugagcacugcggaaaccggggccccagccugagaacgaccacagucaccggcaagaucauccacgaaugguguugccggucuuguacacucccuccccugcgcuuuaaaggggaggacggaugcugguauggcauggagauuagaccggugaaggaaaaggaggaaaaucugguuaaauccauggugagcgcuggguccggagaggucgacucuuucagccuuggccuccuguguaucuccauuaugaucgaagaggugaugcggucuagauggagccgcaagaugcugaugaccgggacgcucgccgucuuuuuccugcuuauuaugggacagcugacauggaacgaucucauccggcugugcauuauggugggcgccaaugcuuccgacagaaugggcauggggaugaccuaccuggcccuuauggcgacauuuaaaaugcgcccuauguucgcugucggacugcucuuuagacggcugaccucucgcgaggugcuccugcuuaccaucggccugagccucguggccuccgucgaacugcccaacagccuggaggaacuuggggauggacuggccaugggcaucaugauucucaagcugcucacagacuuccaaucucaucagcugugggcuacgcuucugucccucaccuuuaucaaaacaaccuucagccugcacuaugccuggaagacaauggcuaugguucugucuauugugucccuuuuuccccugugucucagcaccacgucucagaagacaaccuggcugccugugcuccuggggucccuuggaugcaaaccgcugaccauguuccugaucgccgagaauaagauuuggggcagaaaaagcuggccccucaacgaaggcaucauggcggucgggaucguguccauucugcuuagcucucugcucaagaacgauguuccucuggccggaccccucaucgcuggcgggaugcugauugccuguuacgugaucagcggauccucugcugaccuuagccuggagaaagccgccgaggucuccugggaagaggaagcugagcauucuggcgcgagccacaauauucugguggaaguucaggaugacgggacaaugaagaucaaagaugaggagcgggacgauacccucacaauccugcuuaaggccacgcugcucgcuguguccggagucuauccucugucuauucccgccacccucuucgugugguacuuuuggcaaaagaaaaagcagcgcagcggcguccugugggacacaccuagcccucccgaaguggagagagccguucuugaugacggcaucuaucggauuaugcagcgcgggcugcugggaagaagccaggugggcgucgggguguuccaagaaaacguuuuucauaccauguggcacgugacacggggagcuguccucauguaccagggcaaacgccuggagcccucuugggccuccgugaagaaagaccuuaucagcuacgggggaggcuggagacugcagggcucuuggaauaccggggaggaagugcagguuauugcggucgagcccggaaagaacccuaagaaugugcaaacggcucccggcaccuucaaaacauccgaaggggaggugggagccaucgcccucgauuuuaagccgggcaccagcggguccccuauugucaaccgggaaggaaaaaucgugggccuguauggcaaugggguugugacaaccucuggaacauacgucagcgcuaucgcccaggcgaaggcuucccaggagggcccccucccugagauugaagacgagguguucagaaaacgcaaccugacgaucauggaucuucaccccgggagcggaaagacccggagauaucugcccgccauuguucgcgaagccaucaagcggaaacugagaacacucauucuggcuccuacccgcguggucgccucugagauggcugaagcccuuaagggcaugccgauccgguaccaaaccacagcggugaaauccgagcauacggggaaggagaucguugaccugaugugccacgccaccuuuacaaugagacuccugagccccgugcgcgucccuaauuauaacaugauuaucauggaugaagcucauuucaccgaccccucuagcauugccgcucggggcuacaucuccacaagagugggaaugggcgaggccgccgcuauuuuuaugaccgcgacgccucccgggucuguggaagccuucccucagagcaaugcugucauccaggaugaggaacgggacaucccggagcgcuccuggaacucuggauaugaguggauuacagauuuucccggcaaaaccguuugguucgugccuagcaucaaguccgggaaugacauugccaacugucugagaaagaauggaaaacgggugauccagcucagccgcaagaccuucgauacagaauaccagaagaccaagaacaacgacugggacuacgucgugacaaccgauauuucugagaugggcgccaauuuuagagcugaccggguuaucgaucccagacgcugccuuaaaccugugauucugaaggacgggcccgaacgggucauccuggccggcccgaugccugugacgguugcguccgcugcccagagacgcggacggaucggcagaaaccacaauaaggagggggaucaguauauuuacaugggacagccccucaacaaugacgaggaucaugcccacuggacagaagcuaaaaugcugcuugacaacaucaauacccccgagggcauuaucccugcccuguucgaacccgagcgcgaaaagagcgcggccauugauggggaguaucggcucagaggagaggcucgcaaaacauuuguggaacugaugagacggggcgaccugccugucuggcucuccuacaagguggccucugagggguuccaauauagcgaucgcagauggugcuuugacggcgaacggaacaaucagguccuugaggaaaacauggauguggagaucuggaccaaagagggagaacgcaagaaacugagaccgcgguggcuggacgcuagaacguacuccgacccccucgcccugcgcgaguucaaggaauuugcugccggccggagaucuguuagcggggaucuuauccuggagauuggaaagcucccucagcaccugacccagcgcgcgcaaaaugcccuggacaaccucgugaugcuucauaauuccgaacagggcgggcgggcuuauagacacgccauggaggagcugcccgauacaaucgaaacccugaugcuccuggcucuuauugccgugcugacaggaggcgucacccucuucuuucugagcggccgggggcugggaaaaacaucuaucggccuccuuuguguuauggccuccagcgugcugcuguggauggcuucuguggagccucauuggauugcggccuccaucauccucgaguucuuucugaugguccuucugauucccgagccggaccgccagagaaccccucaggauaaccaacucgcuuacgugguuaucgggcugcuguucaugauucucacgguggccgccaaugagaugggacuucuggaaacaaccaagaaagaccugggcaucgggcacgucgcuguggagaaccaccaucacgccgcgaugcucgaugucgaccugcaucccgccagcgcuuggacccuuuacgccguggcuacaaccauuaucacaccuaugaugcggcacacgauugaaaacaccacagccaauaucucucugaccgcgaucgccaaccaggcugccauucucaugggacuggauaagggcuggcccaucagcaaaauggacauuggcguuccucugcucgcucuugggugcuauucccaggugaauccccugacacugaccgccgcuguccucaugcugguggcccauuacgcgaucauuggaccgggccuucaagccaaggcuacgcgcgaggcccagaagagaaccgcugccgggaucaugaaaaacccuacaguugauggaaucguggccauugaccuggaucccgucguguaugacgcgaaguuugaaaaacagcucggccagaucaugcugcugauucucuguaccucucaaauccuucugaugcggacaaccugggcucugugcgagagcauuacgcucgccacagggccccugaccacacuuugggagggauccccuggcaaguucuggaauaccaccaucgcugugagcauggccaacaucuuccgcggcuccuaccuggccggggcuggacucgccuuuucucugaugaaaagccugggcgggggaagacggggcacaggggcgcagggagaaacgcucggcgagaaguggaagcgccagcuuaaucagcuguccaaaucugaguucaacaccuauaagagaagcggcauuauggagguugaccgguccgaagccaaagaggggcugaagagaggagagacaaccaaacacgcugucucucgcggcacagccaagcuccggugguuuguggaaagaaaucuggugaagccggaggggaaagucaucgaucuuggauguggccgcgggggauggagcuacuauugcgcuggccugaagaaaguuaccgaagugaagggcuacacgaaagggggacccggccacgaggaaccuauucccauggccacauacggguggaaccucgugaagcugcauuccggaaaagacgucuucuuugugccucccgagaagugugauacccugcucugcgacaucggcgagagcucuccuaauccgaccauugaagaggggcggacacuuagaguucugaagaugguggaacccuggcugcgcggaaaccaauucuguaucaaaauucucaauccuuauaugcccuccgucguggagacccuggagcagaugcagcggaagcacggcggcaugcuuguuagaaacccucugagccgcaauucuacacaugaaauguacuggguguccugcgggacgggaaacaucgucagcgcggugaauaugaccucucggaugcuccugaacagauuuacaauggcccaccgcaaacccaccuaugagcgggauguggaccugggcgcugggacaagacacgucgccguugaaccggagguggcuaaccucgauaucauuggacagcgcaucgaaaauauuaagcaugagcacaaauccaccuggcauuacgacgaggauaacccuuauaagacgugggccuaccacggcagcuaugaagugaagcccuccgggagcgcuucuagcauggucaauggagugguuaaacugcuuaccaagcccugggacgugaucccuauggucacacaaauugccaugaccgauacaacccccuucggccagcagagaguguuuaaagagaagguugacacacggaccccuaaagcgaagcgcggcacggcccaaaucauggaagugacagcuaaguggcuguggggguuccucuccagaaacaaaaagccgcggaucuguaccagagaggaauuuacccggaaaguccgcucuaaugccgcuauuggagccguguucguugacgagaaccaguggaauagcgccaaggaggcgguggaagaugagagauuuugggaccugguccaucgggaacgcgagcuucacaaacagggcaagugcgcuacaugcguguacaacaugauggggaagagagagaagaagcugggagaguucggcaaagccaaggggucccgggccaucugguacauguggcucggcgcucgcuuccuggaguuugaagcccugggauucaugaaugaggaucacugguuuucuagagaaaacagccucuccggcgucgagggggagggacugcauaaacuuggcuauauucugcgggacaucucuaagauuagcgggggaaauauguacgcugaugacacggccggcugggauacccgcaucacagaagacgaucuccagaacgaggcgaaaaucaccgacauuauggaacccgagcacgcccugcuugcuaaguccaucuucaagcugacauaucaaaauaaagugguuagagugcagcggccugccaagaacgggaccgucauggaugugauuagccgcagagaccagcggggcucuggacaggugggcacauacgggcucaauaccuuuacgaacauggaagcucaacugauccgccagauggaguccgagggaauuuucagccccucugaacuggagaccccuaaccucgccgaaagagcgcuggauuggcuugagaaacauggcguugaacggcugaagagaauggccaucuccggggacgacuguguggucaaacccaucgaugaccgcuuugcuacagcccucaccgcucugaaugauaugggaaaggugcggaaggacauuccgcagugggagccuagcaaaggcuggaacgauuggcagcaaguucccuucugcucccaccacuuucaucagcuuaucaugaaggacgggagagagauuguggucccuugucgcaaucaggaugaacuggugggccgggccagagucucucagggagcuggcuggagccuccgcgagacagccugccuggggaaauccuaugcgcaaauguggcagcugauguacuuccaccggagagaccuccgccuggccgcuaacgccaucuguagcgccgugcccguugauugggugccuaccucucggacgacaugguccauucaugcucaccaucaguggaugaccacagaagacaugcuuagcgucuggaauagaguguggaucgaggaaaaccccuggauggaggauaagacccacauuucuagcugggaggacguuccguaucugggaaaacgcgaagaccaauggugcggcucccucaucgggcugacggcccgggcgaccugggcuacaaauauccagguggccauuaaccaggucagacggcuuaucggaaaugagaacuaccuggauuacaugaccucuaugaagagauuuaagaaugaaagcgaccucgagggcgcccugugguga

SEQ ID NO: 18575 - RNA, 9879 nt, Artificial Sequence
  derived and/or modified CDS sequence (opt5) from DENV-1__HM181937__SS-prME
agcgugaccaugcugcucaugcugaugcccaccgcccuugcuuuccaccugacgaccagaggcggggagccucauaugaucguguccaagcaggaacggggaaaaucucuccuguuuaagaccagcgccggcguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaaguucacagugguugugggagaugucgcuggcauccucgcccaggggaaaaagaugauucggccgcaacccauggaguacaaauauucuuggaaaagcuggggaaaggccaagaucaucggcgcugacgugcagaauaccaccuuuauuaucgaugggccuaacacacccgaauguccugacgaucagagagcguggaauauuugggagguggaggacuacggauucggcaucuuuaccacgaacauuuggcugaagcugcgcgauuccuauacacaggucugcgaccaccggcuuaugagcgccgcuaucaaagauucuaaggccguucacgccgacaugggcuacuggaucgaauccgagaaaaaugaaaccuggaagcucgcuagagccagcuucauugaggugaagacauguaucuggcccaaaucucauacccugugguccaacggggugcuggaaagcgagaugauuaucccgaagauuuauggaggcccuaucucucaacacaauuaccgccccggguacuucacacagaccgcgggaccuuggcaucucggcaaacuggagcuugauuuugaccugugcgaagggacgaccgucgugguugaugagcacugcggaaaccggggccccagccucagaacaaccacagugaccggcaagaucauucacgaaugguguugccgguccuguacgcugccuccccugcgcuucagaggggaggacggaugcugguauggcauggagauccggccggucaaagaaaaggaggaaaaucuugucaagagcaugguuucugcuggguccggagagguggacagcuuuucccucggccugcuguguauuucuaucaugauugaagaggucaugagaagccgcuggucccggaaaaugcucaugacagggacccuggccguguuccuucugcucaucaugggacagcugacauggaacgaucugauuagacuuugcaucaugguuggcgccaaugcuucugaccgcaugggcauggggaccaccuaccuggcccucauggcgacauuuaagaugagaccuauguucgcugugggacugcucuuucggcgccugacgagcagagagguccuucugcucaccaucggccugucccugguggccucuguggaacuucccaacagccuggaggaacucggggauggacuggccaugggcauuaugauccucaaacugcuuacagacuuccaaucccaucagcugugggcuacccuccugagccugacauuuauuaagaccacguucucucuucacuaugccuggaaaacaauggcuaugguccuguccaucguuagccucuuuccccugugucucucuaccaccucccagaagacaaccuggcugccugugcuucuggggagccugggaugcaagccgcucacaauguuccugauugccgagaauaaaaucuggggccggcgcucuuggccccuuaacgaaggcaucauggcgguggggauugucuccauccugcucagcucccugcucaagaacgaugugccucuggccggaccccuuauugcuggcgggaugcugaucgccuguuacguuauuagcggaucuagcgcugaccugucccucgagaaagccgccgaggugucuugggaagaggaagcugagcauagcggcgcgucccacaauauccuggucgaagugcaggaugacgggacgaugaagaucaaagaugaggagagagacgauacccuuacaauucugcucaaggccacccugcucgcuguuucuggaguguauccucugagcauccccgccacacuuuuugucugguacuucuggcagaagaagaagcagcgguccggcgugcugugggacaccccuucucccccggaagucgagcgcgccgugcuggaugacggcauuuauagaaucaugcagcgggggcuccugggacgcagccagguuggcgugggggucuuccaagaaaacguguuucauacgauguggcacguuaccagaggagcugugcuuauguaccagggcaaacggcuggagccuuccugggccagcgucaagaaagaccucauuucuuacgggggaggcuggagacugcagggcuccuggaauacaggggaggaagugcaagugaucgcgguugagcccggaaagaacccuaaaaauguccaaaccgcucccggcacauucaagaccccggaaggggaggugggagccauugcccucgauuuuaagccuggcacaagcgggucucccaucgugaaccgcgaaggaaaaaucgucggccuguauggcaauggggugguuacgaccuccggaacauacgugagcgcuauugcccaggcgaaggcuucccaggagggcccucuucccgagaucgaagacgaggucuuccggaaaagaaaccugaccauuauggaucugcaccccgggucuggaaagacccgccgguaucucccugccaucgugagagaagccauuaaacgcaagcugcggacacuuauccuggcuccgacgagaguuguggccagcgagauggcugaagcccucaagggcaugcccauccgcuaccaaaccacagcggucaaauccgagcauaccgggaaggagauuguggaccugaugugccacgccacauuuaccaugcggcugcucagcccuguuagagugcccaauuauaacaugaucauuauggaugaagcucauuucacggacccuucuuccaucgccgcucggggcuacauuagcacacgcgucggaaugggcgaggccgccgcuaucuuuaugaccgcgacacccccugggucuguggaagccuucccgcagagcaaugcugugauccaggaugaggaaagagacauucccgagcgguccuggaacucuggauaugaguggaucacagauuuuccuggcaaaaccgucugguucguucccagcauuaaguccgggaaugacaucgccaacugucuucgcaaaaauggaaagagagugauucagcugucucggaagacauuugauaccgaauaccagaaaacgaagaacaacgacugggacuacguggucacaaccgauaucagcgagaugggcgccaauuucagagcugaccgcgugauugauccucggagaugccugaaacccguuauccucaaggacgggccggaacgcgugauccuggccggcccuaugcccgucacaguggcguccgcugcccagcggagaggacgcauuggccggaaccacaauaaagagggggaucaguauaucuacaugggacagccccuuaacaaugacgaggaucaugcccacuggaccgaagcuaagaugcugcucgacaacauuaauacgccugagggcaucauucccgcccuguucgaaccugagagagaaaagagcgcggccaucgauggggaguaucgccugagaggagaggcucggaaaaccuuuguugaacucaugcgcagaggcgaccuuccgguguggcugucuuacaaggucgccuccgagggguuccaauauagcgaucggcgcuggugcuuugacggcgaaagaaacaaucaggugcuggaggaaaacauggaugucgagaucuggacaaaagagggagaacggaagaaacucagaccccgcuggcuggacgcucggaccuacuccgacccucuugcccugagagaguucaaggaauuugcugccggccgccggucugugagcggggaucucauucuggagaucggaaaacugccccagcaccucacacagagagcgcaaaaugcccuugacaaccugguuaugcugcauaauuccgaacagggcgggcgggcuuaucgccacgccauggaggagcucccugauaccauugaaacacugaugcuucuggcucucaucgccgugcugaccggaggcgugacgcuguucuuucucucuggcagagggcuuggaaagacaagcauuggccugcugugugucauggccuccagcguucuccuguggauggcuucuguggagccccauuggaucgcggccuccaucauucuugaguucuuucugauggugcuccugaucccggagccugaccggcagcgcacaccccaggauaaccaacuggcuuacgucgugauugggcuccuuuucaugauccugaccguugccgccaaugagaugggacugcucgaaacaaccaagaaagaccugggcauugggcacguggcugucggaaaccaccaucacgccgcgaugcuugauguggaccugcauccugccagcgcuuggacacucuacgccgucgcuacgaccaucauuacacccaugaugagacacaccaucgagaacacaaccgccaauaucucucugacggcgauugccaaccaggcugccauccugaugggccucgauaagggcuggccuauuuccaaaauggacaucggggugccccuucuggcucugggaugcuauagccagguuaauccgcucacccugacagccgcugugcuuaugcuggucgcccauuacgcgauuaucggcccugggcuccaagccaaggcuacccgggaagcccagaaacgcacagcugccggaaucaugaagaaccccaccguggauggcauuguugccaucgaccuggaucccguggucuaugacgcgaaguuugagaaacagcuggggcagauuaugcuccuuauccuguguacgucucaaauucugcucaugagaacaaccugggcucugugcgaaagcaucacacuugccaccggaccucugaccacacucugggagggcuccccgggcaaguucuggaauacgaccaucgcugugucuauggccaacauuuuucgggggagcuaccuggccggagcuggccuggccuucucccucaugaaaagccuugggggaggccgcagagggacaggagcgcagggcgagacccugggcgaaaaguggaaacggcagcugaaucagcucuccaagucugaguucaacacauauaagagaagcgggaucauggaaguggaccgcuccgaggccaaagaaggacugaagcggggcgagaccacgaaacacgcuguuucuagagggacagccaaacuucgcugguuugucgagcggaaucuggugaaacccgaaggaaaggugauugaucucggcugugggagaggaggcuggagcuacuauugcgcuggccugaagaaagucaccgagguuaagggguacaccaaaggaggcccugggcacgaagaacccaucccuauggccacauacggauggaaccuggugaagcuccauuccggcaaagacguguucuuuauucccccugaaaagugugauacccuucugugcgacaucggggagucuagcccgaaucccacaauugaggaaggacgcacgcugcggguccucaaaaugguggagccuuggcugagaggcaaccaauucuguaucaagauccuuaaucccuauaugccuuccguuguggaaacccuggagcagaugcagcgcaagcacggcgggaugcucguccggaacccccugagcagaaauucuacacaugagauguacuggguguccugcggaaccggcaacauuguuagcgcggugaauaugacaucucgcaugcugcucaaccgguuuaccauggcccacagaaaaccgacguaugaacgcgaugucgaccugggggcuggaaccagacacguggccguggagccugaagucgcuaaccuugauaucauuggccagcggaucgagaauauuaagcaugaacacaaauccacauggcauuacgacgaggauaaccccuauaagaccugggccuaccacgggagcuaugagguuaaacccucuggauccgcuagcuccauggugaauggcguggucaagcugcucacaaagccuugggacgugauccccaugguuacccaaaucgccaugacagauaccacgccuuucggccagcagcgcguguuuaaagaaaaggucgacacaagaaccccgaaagcgaagcgggggaccgcccaaauuauggaggugacagcuaaauggcuguggggauuccuuagcagaaacaagaagccccggaucuguacgcgcgaagaguuuaccagaaaaguucggucuaaugccgcuauuggcgccguguucgucgacgaaaaccaguggaauagcgccaaggaggcgguggaggaugaacgcuuuugggaccugguucauaaagagagagaacuccacaagcaggggaaaugcgcuacaugcguguacaacaugaugggaaagcgggagaagaaacugggcgaguucgggaaggccaaaggcucccgcgccaucugguacauguggcugggagcuagauuucucgaguucgaggcccugggcuucaugaaugaagaucacugguuuucucgggagaacagccuuuccggggucgaaggagagggccugcauaagcucggguauauucugcgcgacaucucuaaaaucccuggaggcaauauguacgcugaugacaccgccgggugggauacaagaauuaccgaggacgaucuucagaacgaagcgcggaucacagacauuauggagcccgaacacgcccugcucgcuaagagcaucuucaaacugaccuaucaaaauaaggugguccgcgugcagagaccugccaagaacggcacgguuauggaugugauuucccggcgcgaccagagaggaucuggccaggucgggaccuacggacugaauacauuuaccaacaucgaggcucaacucauccggcagauggaaagcgagggcauuuucucccccagcgagcuggaaacaccgaaccuugccgagagagugcuggauuggcucgaaaaauaugggguggagcgccugaagcggauggcgaucucuggagacgacuguguugugaaaccuauugaugacagauuugccaccgcucuuacggcccugaaugauaugggcaagguccgcaaagacaucccccagugggaaccuuccaagggguggaacgauuggcagcaagugcccuucugcagccaucacuuucaccagcucauuaugaaggacggccgggagaucguugugccuuguagaaaucaggaugagcuggucggacgcgcucgggugucucagggcgccggguggucccugagagaaacagcuugccucggaaaaagcuacgcccaaauguggcagcugauguauuuccaucgccgggaccuuagacuggcggccaacgcuauuuguuccgccguccccguggauuggaucccgaccucucgcacaaccuggagcauccacgcccaucaccaguggaugacgaccgaggacaugcucuccguuuggaaucggguguggauugaagagaacccuuggauggaagauaagacacauaucagcucuuggggcgacguccccuaccuggggaaaagagaggaccaauggugcggaucccuuauuggccugaccgcucgggccacaugggcgaccaauauccagguggcuauuaaccagguuagacgccucaucgggaaugagaacuaccuggauuauaugacaagcaugaagcgguuuaaaaaugaaucugaccccgagggcgcccugugguga

SEQ ID NO: 18576 - RNA, 9879 nt, Artificial Sequence
  derived and/or modified CDS sequence (opt5) from DENV-1__HM181939__SS-prME
uccgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucuccgaagcugaacccgacgauguggacuguuggugcaaugccacagauaccugggugacguauggaaccuguucucaaacaggcgagcacagacgggacaagcgcagcguugcccucgcuccucauguggggcugggacuggagaccagaacagaaaccuggauguccucugagggcgccuggaaacagauucagcggguugaaacgugggcucuccgccaccccggcuuuacagugaucgcccuguuccuugcgcaugccauugggaccagcaucacacagaagggaaucauuuuuauccugcucaugcuggucaccccuuccauggcuaugagaugcgugggcauugggagccgggauuucguugagggacuuucuggcgccaccuggguggacgucgugcuggagcacggguccugugugacaacgauggcuaaggauaaacccacccucgacaucgaacugcugaagacagaggucaccaacccugccguucuccgcaaacugugcauugaagcgaagaucagcaauacaaccacggauucuagauguccgacacaaggagaggccacccuuguggaagaacaagacgcuaacuuugugugccggcgcaccuucgucgauagaggcuggggcaauggguguggacuguuuggcaaagggucccucauuacaugcgccaaguucaagugcgugaccaaacuggagggaaagaucguucaguacgaaaaccuuaaauauagcgugaucgucacagugcacacgggcgaccagcaucaaguugggaaugagucuaccgaacacggaacaaccgcuacaauuacaccccaggccccuuccacggagauccagcugaccgacuacggcgcccucacacuggauuguagcccccggaccggccuggacuuuaacgaaauggugcuccugacaaugaaggagaaauccuggcuuguccauaagcagugguuccuggaucucccucugcccuggaccucuggggcuagcacgucccaagagacauggaaucgccaggaccuucuggugaccuuuaaaacagcgcacgccaagaagcaggaagucgugguucucggaagccaagagggcgcuaugcacaccgcccugaccggggccacagaaauucagacgucuggaaccacaaccaucuucgcuggccaucugaaaugcagacucaagauggauaaacugacacuuaaggggauguccuaugugauguguaccggcagcuucaaacuggagaaggaagucgccgagacgcagcacggaacagugcucguucagauuaaguacgagggcaccgacgcgccgugcaaaaucccuuuuucuacccaagaugaaaagggggugacacagaacggacggcugaucaccgcuaaucccauugucacagacaaagagaagccugugaacaucgaagccgagccgcccuucggcgagagcuauauugugaucggggccggagaaaaagcucugaaacuuuccugguuuaagaaaggcucuagcauugggaagauguucgaggccacggcuagaggcgcccgccggauggcgauccucggagauaccgccugggacuuuggcuccaucgggggaguuuucacaagcgucggcaaacuggugcaucagauuuuugggaccgcuuacggagugcuguucucuggcgucuccuggacaaugaagaucgggauuggcgugcuccugaccuggcuuggacugaauagcagaucuacgucccucagcaugaccuguaucgccguuggccuggugacacuguaccuuggggucauggugcaggcugauuccggaugcguuauuaacuggaaaggccgcgaacucaagugugggucuggaaucuuugugaccaaugagguccacacauggaccgaacaauauaaguuccaggccgacagcccuaaacggcuguccgcggccauuggcaaggcuugggaggagggggugugcggcaucagaucugccacacgccuggaaaacaucauguggaaacagauuagcaacgagcucaaucauauccugcuugaaaacgacaugaaguuuaccguuguggucggagauguggcuggcauucuggcccaggggaaaaagaugauccggccgcaacccauggaguacaaauauuccuggaaaagcuggggaaaggccaagauuaucggcgcugacgugcagaauacgacauucaucauugaugggccuaacacccccgaauguccugacgaucagagagcguggaauaucugggaggucgaggacuacggauuuggcauuuucaccacaaacaucuggcucaagcugcgcgauucuuauacccagguuugcgaccaccggcugauguccgccgcuauuaaagauagcaaggccgugcacgccgacaugggcuacuggaucgaaucugagaaaaaugaaacguggaaacuugcuagagccuccuucaucgaggugaagacauguauuuggcccaaaagccauacccucuggucuaacgggguccuggaaagcgagaugaucauuccgaagaucuauggaggcccuauuucccaacacaauuaccgccccggguacuuuacacagaccgcgggaccuuggcaucugggcaaacucgagcuggauuucgaccuuugcgaagggacaaccgugguuguggaugagcacugcggaaaccggggccccagccugagaacgaccacagucaccggcaagaucauccacgaaugguguugccggucuuguacacucccuccccugcgcuuuaaaggggaggacggaugcugguauggcauggagauuagaccggugaaggaaaaggaggaaaaucugguuaaauccauggugagcgcuggguccggagaggucgacucuuucagccuuggccuccuguguaucuccauuaugaucgaagaggugaugcggucuagauggagccgcaagaugcugaugaccgggacgcucgccgucuuuuuccugcuuauuaugggacagcugacauggaacgaucucauccggcugugcauuauggugggcgccaaugcuuccgacagaaugggcauggggaugaccuaccuggcccuuauggcgacauuuaaaaugcgcccuauguucgcugucggacugcucuuuagacggcugaccucucgcgaggugcuccugcuuaccaucggccugagccucguggccuccgucgaacugcccaacagccuggaggaacuuggggauggacuggccaugggcaucaugauucucaagcugcucacagacuuccaaucucaucagcugugggcuacgcuucugucccucaccuuuaucaaaacaaccuucagccugcacuaugccuggaagacaauggcuaugguucugucuauugugucccuuuuuccccugugucucagcaccacgucucagaagacaaccuggcugccugugcuccuggggucccuuggaugcaaaccgcugaccauguuccugaucgccgagaauaagauuuggggcagaaaaagcuggccccucaacgaaggcaucauggcggucgggaucguguccauucugcuuagcucucugcucaagaacgauguuccucuggccggaccccucaucgcuggcgggaugcugauugccuguuacgugaucagcggauccucugcugaccuuagccuggagaaagccgccgaggucuccugggaagaggaagcugagcauucuggcgcgagccacaauauucugguggaaguucaggaugacgggacaaugaagaucaaagaugaggagcgggacgauacccucacaauccugcuuaaggccacgcugcucgcuguguccggagucuauccucugucuauucccgccacccucuucgugugguacuuuuggcaaaagaaaaagcagcgcagcggcguccugugggacacaccuagcccucccgaaguggagagagccguucuugaugacggcaucuaucggauuaugcagcgcgggcugcugggaagaagccaggugggcgucgggguguuccaagaaaacguuuuucauaccauguggcacgugacacggggagcuguccucauguaccagggcaaacgccuggagcccucuugggccuccgugaagaaagaccuuaucagcuacgggggaggcuggagacugcagggcucuuggaauaccggggaggaagugcagguuauugcggucgagcccggaaagaacccuaagaaugugcaaacggcucccggcaccuucaaaacauccgaaggggaggugggagccaucgcccucgauuuuaagccgggcaccagcggguccccuauugucaaccgggaaggaaaaaucgugggccuguauggcaaugggguugugacaaccucuggaacauacgucagcgcuaucgcccaggcgaaggcuucccaggagggcccccucccugagauugaagacgagguguucagaaaacgcaaccugacgaucauggaucuucaccccgggagcggaaagacccggagauaucugcccgccauuguucgcgaagccaucaagcggaaacugagaacacucauucuggcuccuacccgcguggucgccucugagauggcugaagcccuuaagggcaugccgauccgguaccaaaccacagcggugaaauccgagcauacggggaaggagaucguugaccugaugugccacgccaccuuuacaaugagacuccugagccccgugcgcgucccuaauuauaacaugauuaucauggaugaagcucauuucaccgaccccucuagcauugccgcucggggcuacaucuccacaagagugggaaugggcgaggccgccgcuauuuuuaugaccgcgacgccucccgggucuguggaagccuucccucagagcaaugcugucauccaggaugaggaacgggacaucccggagcgcuccuggaacucuggauaugaguggauuacagauuuucccggcaaaaccguuugguucgugccuagcaucaaguccgggaaugacauugccaacugucugagaaagaauggaaaacgggugauccagcucagccgcaagaccuucgauacagaauaccagaagaccaagaacaacgacugggacuacgucgugacaaccgauauuucugagaugggcgccaauuuuagagcugaccggguuaucgaucccagacgcugccuuaaaccugugauucugaaggacgggcccgaacgggucauccuggccggcccgaugccugugacgguugcguccgcugcccagagacgcggacggaucggcagaaaccacaauaaggagggggaucaguauauuuacaugggacagccccucaacaaugacgaggaucaugcccacuggacagaagcuaaaaugcugcuugacaacaucaauacccccgagggcauuaucccugcccuguucgaacccgagcgcgaaaagagcgcggccauugauggggaguaucggcucagaggagaggcucgcaaaacauuuguggaacugaugagacggggcgaccugccugucuggcucuccuacaagguggccucugagggguuccaauauagcgaucgcagauggugcuuugacggcgaacggaacaaucagguccuugaggaaaacauggauguggagaucuggaccaaagagggagaacgcaagaaacugagaccgcgguggcuggacgcuagaacguacuccgacccccucgcccugcgcgaguucaaggaauuugcugccggccggagaucuguuagcggggaucuuauccuggagauuggaaagcucccucagcaccugacccagcgcgcgcaaaaugcccuggacaaccucgugaugcuucauaauuccgaacagggcgggcgggcuuauagacacgccauggaggagcugcccgauacaaucgaaacccugaugcuccuggcucuuauugccgugcugacaggaggcgucacccucuucuuucugagcggccgggggcugggaaaaacaucuaucggccuccuuuguguuauggccuccagcgugcugcuguggauggcuucuguggagccucauuggauugcggccuccaucauccucgaguucuuucugaugguccuucugauucccgagccggaccgccagagaaccccucaggauaaccaacucgcuuacgugguuaucgggcugcuguucaugauucucacgguggccgccaaugagaugggacuucuggaaacaaccaagaaagaccugggcaucgggcacgucgcuguggagaaccaccaucacgccgcgaugcucgaugucgaccugcaucccgccagcgcuuggacccuuuacgccguggcuacaaccauuaucacaccuaugaugcggcacacgauugaaaacaccacagccaauaucucucugaccgcgaucgccaaccaggcugccauucucaugggacuggauaagggcuggcccaucagcaaaauggacauuggcguuccucugcucgcucuugggugcuauucccaggugaauccccugacacugaccgccgcuguccucaugcugguggcccauuacgcgaucauuggaccgggccuucaagccaaggcuacgcgcgaggcccagaagagaaccgcugccgggaucaugaaaaacccuacaguugauggaaucguggccauugaccuggaucccgucguguaugacgcgaaguuugaaaaacagcucggccagaucaugcugcugauucucuguaccucucaaauccuucugaugcggacaaccugggcucugugcgagagcauuacgcucgccacagggccccugaccacacuuugggagggauccccuggcaaguucuggaauaccaccaucgcugugagcauggccaacaucuuccgcggcuccuaccuggccggggcuggacucgccuuuucucugaugaaaagccugggcgggggaagacggggcacaggggcgcagggagaaacgcucggcgagaaguggaagcgccagcuuaaucagcuguccaaaucugaguucaacaccuauaagagaagcggcauuauggagguugaccgguccgaagccaaagaggggcugaagagaggagagacaaccaaacacgcugucucucgcggcacagccaagcuccggugguuuguggaaagaaaucuggugaagccggaggggaaagucaucgaucuuggauguggccgcgggggauggagcuacuauugcgcuggccugaagaaaguuaccgaagugaagggcuacacgaaagggggacccggccacgaggaaccuauucccauggccacauacggguggaaccucgugaagcugcauuccggaaaagacgucuucuuugugccucccgagaagugugauacccugcucugcgacaucggcgagagcucuccuaauccgaccauugaagaggggcggacacuuagaguucugaagaugguggaacccuggcugcgcggaaaccaauucuguaucaaaauucucaauccuuauaugcccuccgucguggagacccuggagcagaugcagcggaagcacggcggcaugcuuguuagaaacccucugagccgcaauucuacacaugaaauguacuggguguccugcgggacgggaaacaucgucagcgcgaucaauaugaccucucggaugcuccugaacagauuuacaauggcccaccgcaaacccaccuaugagcgggauguggaccugggcgcugggacaagacacguggccgucgaaccggagguugcuaaccucgauauuaucggacagcgcauugaaaauaucaagcaugagcacaaauccaccuggcauuacgacgaggauaacccuuauaagacgugggccuaccacggcagcuaugaagugaagcccuccgggagcgcuucuagcauggugaauggagucgugaaacugcuuaccaagcccugggacguuauuccuauggugacacaaaucgccaugaccgauacaacccccuucggccagcagagagucuuuaaagagaagguggacacacggaccccuaaagcgaagcgcggcacggcccaaaucauggaaguuacagcuaaguggcuguggggguuccucuccagaaacaaaaagccgcggauuuguaccagagaggaauuuacccggaaagugcgcucuaaugccgcuaucggagccgucuucguggacgagaaccaguggaauagcgccaaggaggcgguugaagaugagagauuuugggaccuggugcaucgggaacgcgagcuucacaaacagggcaagugcgcuacaugcgucuacaacaugauggggaagagagagaagaagcugggagaguucggcaaagccaaggggucccgggccauuugguacauguggcucggcgcucgcuuccuggaguuugaagcccugggauucaugaaugaggaucacugguuuucuagagaaaacagccucuccggcguggagggggagggacugcauaaacuuggcuauauccugcgggacauuucuaagaucagcgggggaaauauguacgcugaugacacggccggcugggauacccgcaucacagaagacgaucuccagaacgaggcgaaaauuaccgacaucauggaacccgagcacgcccugcuugcuaauuccauuuucaagcugacauaucaaaacaaggucgugagaguucagcggccugccaaaaaugggaccgugauggaugucaucagccgcagagaccagcggggcucuggacaggugggcacauacgggcucaacaccuuuacgaacauggaagcucaacugauucgccagauggaguccgagggaaucuucagccccucugaacuggagaccccuaaucucgccgaaagagugcuggauuggcuugagaagcauggcguugaacggcugaaaagaauggcgaucuccggggacgacuguguggucaagcccauugaugaccgcuuugccacagcucucaccgcccugaacgauaugggaaaagugcggaaggacaucccgcagugggagccuagcaagggcuggaaugauuggcagcaaguucccuucugcucccaccacuuucaucagcuuauuaugaaagacgggagagagaucguggucccuugucgcaaccaggaugaacuggugggccgggcuagagucucucagggagccggcuggagccuccgcgagacagcuugccuggggaaguccuaugcccaaauguggcagcugauguacuuccaccggagagaccuccgccuggcggccaaugcuauuuguagcgccgugcccguugauugggugccuaccucucggacgacaugguccauccaugcccaccaucaguggaugaccacagaagacaugcuuagcgucuggaacagaguguggauugaggaaaaucccuggauggaggauaaaacccacaucucuagcugggaggacguuccguaucugggaaagcgcgaagaccaauggugcggcucccucaucgggcugacggcucgggccaccugggcgacaaacauucagguggcuaucaaucaggucagacggcuuauuggaaacgagaauuaccuggauuacaugaccucuaugaaaagauuuaagaacgaaagcgacccugagggcgcccucugguga

SEQ ID NO: 18577 - RNA, 9879 nt, Artificial Sequence
  derived and/or modified CDS sequence (opt5) from DENV-1__HM181942__SS-prME
uccgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucuccgaagcugaacccgacgauguggacuguuggugcaaugccacagauaccugggugacguauggaaccuguucucaaacaggcgagcacagacgggacaagcgcagcguugcccucgcuccucauguggggcugggacuggagaccagaacagaaaccuggauguccucugagggcgccuggaaacagauucagcggguugaaacgugggcucuccgccaccccggcuuuacagugaucgcccuguuccuugcgcaugccauugggaccagcaucacacagaagggaaucauuuuuauccugcucaugcuggucaccccuuccauggcuaugagaugcgugggcauugggagccgggauuucguugagggacuuucuggcgccaccuggguggacgucgugcuggagcacggguccugugugacaacgauggcuaaggauaaacccacccucgacaucgaacugcugaagacagaggucaccaacccugccguucuccgcaaacugugcauugaagcgaagaucagcaauacaaccacggauucuagauguccgacacaaggagaggccacccuuguggaagaacaagacgcuaacuuugugugccggcgcaccuucgucgauagaggcuggggcaauggguguggacuguuuggcaaagggucccucauuacaugcgccaaguucaagugcgugaccaaacuggagggaaagaucguucaguacgaaaaccuuaaauauagcgugaucgucacagugcacacgggcgaccagcaucaaguugggaaugagucuaccgaacacggaacaaccgcuacaauuacaccccaggccccuuccacggagauccagcugaccgacuacggcgcccucacacuggauuguagcccccggaccggccuggacuuuaacgaaauggugcuccugacaaugaaggagaaauccuggcuuguccauaagcagugguuccuggaucucccucugcccuggaccucuggggcuagcacgucccaagagacauggaaucgccaggaccuucuggugaccuuuaaaacagcgcacgccaagaagcaggaagucgugguucucggaagccaagagggcgcuaugcacaccgcccugaccggggccacagaaauucagacgucuggaaccacaaccaucuucgcuggccaucugaaaugcagacucaagauggauaaacugacacuuaaggggauguccuaugugauguguaccggcagcuucaaacuggagaaggaagucgccgagacgcagcacggaacagugcucguucagauuaaguacgagggcaccgacgcgccgugcaaaaucccuuuuucuacccaagaugaaaagggggugacacagaacggacggcugaucaccgcuaaucccauugucacagacaaagagaagccugugaacaucgaagccgagccgcccuucggcgagagcuauauugugaucggggccggagaaaaagcucugaaacuuuccugguuuaagaaaggcucuagcauugggaagauguucgaggccacggcuagaggcgcccgccggauggcgauccucggagauaccgccugggacuuuggcuccaucgggggaguuuucacaagcgucggcaaacuggugcaucagauuuuugggaccgcuuacggagugcuguucucuggcgucuccuggacaaugaagaucgggauuggcgugcuccugaccuggcuuggacugaauagcagaucuacgucccucagcaugaccuguaucgccguuggccuggugacacuguaccuuggggucauggugcaggcugauuccggaugcguuauuaacuggaaaggccgcgaacucaagugugggucuggaaucuuugugaccaaugagguccacacauggaccgaacaauauaaguuccaggccgacagcccuaaacggcuguccgcggccauuggcaaggcuugggaggagggggugugcggcaucagaucugccacacgccuggaaaacaucauguggaaacagauuagcaacgagcucaaucauauccugcuugaaaacgacaugaaguuuaccguuguggucggagauguggcuggcauucuggcccaggggaaaaagaugauccggccgcaacccauggaguacaaauauuccuggaaaagcuggggaaaggccaagauuaucggcgcugacgugcagaauacgacauucaucauugaugggccuaacacccccgaauguccugacgaucagagagcguggaauaucugggaggucgaggacuacggauuuggcauuuucaccacaaacaucuggcucaagcugcgcgauucuuauacccagguuugcgaccaccggcugauguccgccgcuauuaaagauagcaaggccgugcacgccgacaugggcuacuggaucgaaucugagaaaaaugaaacguggaaacuugcuagagccuccuucaucgaggugaagacauguauuuggcccaaaagccauacccucuggucuaacgggguccuggaaagcgagaugaucauuccgaagaucuauggaggcccuauuucccaacacaauuaccgccccggguacuuuacacagaccgcgggaccuuggcaucugggcaaacucgagcuggauuucgaccuuugcgaagggacaaccgugguuguggaugagcacugcggaaaccggggccccagccugagaacgaccacagucaccggcaagaucauccacgaaugguguugccggucuuguacacucccuccccugcgcuuuaaaggggaggacggaugcugguauggcauggagauuagaccggugaaggaaaaggaggaaaaucugguuaaauccauggugagcgcuggguccggagaggucgacucuuucagccuuggccuccuguguaucuccauuaugaucgaagaggugaugcggucuagauggagccgcaagaugcugaugaccgggacgcucgccgucuuuuuccugcuuauuaugggacagcugacauggaacgaucucauccggcugugcauuauggugggcgccaaugcuuccgacagaaugggcauggggaugaccuaccuggcccuuauggcgacauuuaaaaugcgcccuauguucgcugucggacugcucuuuagacggcugaccucucgcgaggugcuccugcuuaccaucggccugagccucguggccuccgucgaacugcccaacagccuggaggaacuuggggauggacuggccaugggcaucaugauucucaagcugcucacagacuuccaaucucaucagcugugggcuacgcuucugucccucaccuuuaucaaaacaaccuucagccugcacuaugccuggaagacaauggcuaugguucugucuauugugucccuuuuuccccugugucucagcaccacgucucagaagacaaccuggcugccugugcuccuggggucccuuggaugcaaaccgcugaccauguuccugaucgccgagaauaagauuuggggcagaaaaagcuggccccucaacgaaggcaucauggcggucgggaucguguccauucugcuuagcucucugcucaagaacgauguuccucuggccggaccccucaucgcuggcgggaugcugauugccuguuacgugaucagcggauccucugcugaccuuagccuggagaaagccgccgaggucuccugggaagaggaagcugagcauucuggcgcgagccacaauauucugguggaaguucaggaugacgggacaaugaagaucaaagaugaggagcgggacgauacccucacaauccugcuuaaggccacgcugcucgcuguguccggagucuauccucugucuauucccgccacccucuucgugugguacuuuuggcaaaagaaaaagcagcgcagcggcguccugugggacacaccuagcccucccgaaguggagagagccguucuugaugacggcaucuaucggauuaugcagcgcgggcugcugggaagaagccaggugggcgucgggguguuccaagaaaacguuuuucauaccauguggcacgugacacggggagcuguccucauguaccagggcaaacgccuggagcccucuugggccuccgugaagaaagaccuuaucagcuacgggggaggcuggagacugcagggcucuuggaauaccggggaggaagugcagguuauugcggucgagcccggaaagaacccuaagaaugugcaaacggcucccggcaccuucaaaacauccgaaggggaggugggagccaucgcccucgauuuuaagccgggcaccagcggguccccuauugucaaccgggaaggaaaaaucgugggccuguauggcaaugggguugugacaaccucuggaacauacgucagcgcuaucgcccaggcgaaggcuucccaggagggcccccucccugagauugaagacgagguguucagaaaacgcaaccugacgaucauggaucuucaccccgggagcggaaagacccggagauaucugcccgccauuguucgcgaagccaucaagcggaaacugagaacacucauucuggcuccuacccgcguggucgccucugagauggcugaagcccuuaagggcaugccgauccgguaccaaaccacagcggugaaauccgagcauacggggaaggagaucguugaccugaugugccacgccaccuuuacaaugagacuccugagccccgugcgcgucccuaauuauaacaugauuaucauggaugaagcucauuucaccgaccccucuagcauugccgcucggggcuacaucuccacaagagugggaaugggcgaggccgccgcuauuuuuaugaccgcgacgccucccgggucuguggaagccuucccucagagcaaugcugucauccaggaugaggaacgggacaucccggagcgcuccuggaacucuggauaugaguggauuacagauuuucccggcaaaaccguuugguucgugccuagcaucaaguccgggaaugacauugccaacugucugagaaagaauggaaaacgggugauccagcucagccgcaagaccuucgauacagaauaccagaagaccaagaacaacgacugggacuacgucgugacaaccgauauuucugagaugggcgccaauuuuagagcugaccggguuaucgaucccagacgcugccuuaaaccugugauucugaaggacgggcccgaacgggucauccuggccggcccgaugccugugacgguugcguccgcugcccagagacgcggacggaucggcagaaaccacaauaaggagggggaucaguauauuuacaugggacagccccucaacaaugacgaggaucaugcccacuggacagaagcuaaaaugcugcuugacaacaucaauacccccgagggcauuaucccugcccuguucgaacccgagcgcgaaaagagcgcggccauugauggggaguaucggcucagaggagaggcucgcaaaacauuuguggaacugaugagacggggcgaccugccugucuggcucuccuacaagguggccucugagggguuccaauauagcgaucgcagauggugcuuugacggcgaacggaacaaucagguccuugaggaaaacauggauguggagaucuggaccaaagagggagaacgcaagaaacugagaccgcgguggcuggacgcuagaacguacuccgacccccucgcccugcgcgaguucaaggaauuugcugccggccggagaucuguuagcggggaucuuauccuggagauuggaaagcucccucagcaccugacccagcgcgcgcaaaaugcccuggacaaccucgugaugcuucauaauuccgaacagggcgggcgggcuuauagacacgccauggaggagcugcccgauacaaucgaaacccugaugcuccuggcucuuauugccgugcugacaggaggcgucacccucuucuuucugagcggccgggggcugggaaaaacaucuaucggccuccuuuguguuauggccuccagcgugcugcuguggauggcuucuguggagccucauuggauugcggccuccaucauccucgaguucuuucugaugguccuucugauucccgagccggaccgccagagaaccccucaggauaaccaacucgcuuacgugguuaucgggcugcuguucaugauucucacgguggccgccaaugagaugggacuucuggaaacaaccaagaaagaccugggcaucgggcacgucgcuguggagaaccaccaucacgccgcgaugcucgaugucgaccugcaucccgccagcgcuuggacccuuuacgccguggcuacaaccauuaucacaccuaugaugcggcacacgauugaaaacaccacagccaauaucucucugaccgcgaucgccaaccaggcugccauucucaugggacuggauaagggcuggcccaucagcaaaauggacauuggcguuccucugcucgcucuugggugcuauucccaggugaauccccugacacugaccgccgcuguccucaugcugguggcccauuacgcgaucauuggaccgggccuucaagccaaggcuacgcgcgaggcccagaagagaaccgcugccgggaucaugaaaaacccuacaguugauggaaucguggccauugaccuggaucccgucguguaugacgcgaaguuugaaaaacagcucggccagaucaugcugcugauucucuguaccucucaaauccuucugaugcggacaaccugggcucugugcgagagcauuacgcucgccacagggccccugaccacacuuugggagggauccccuggcaaguucuggaauaccaccaucgcugugagcauggccaacaucuuccgcggcuccuaccuggccggggcuggacucgccuuuucucugaugaaaagccugggcgggggaagacggggcacaggggcgcagggagaaacgcucggcgagaaguggaagcgccagcuuaaucagcuguccaaaucugaguucaacaccuauaagagaagcggcauuauggagguugaccgguccgaagccaaagaggggcugaagagaggagagacaaccaaacacgcugucucucgcggcacagccaagcuccggugguuuguggaaagaaaucuggugaagccggaggggaaagucaucgaucuuggauguggccgcgggggauggagcuacuauugcgcuggccugaagaaaguuaccgaagugaagggcuacacgaaagggggacccggccacgaggaaccuauucccauggccacauacggguggaaccucgugaagcugcauuccggaaaagacgucuucuuugugccucccgagaagugugauacccugcucugcgacaucggcgagagcucuccuaauccgaccauugaagaggggcggacacuuagaguucugaagaugguggaacccuggcugcgcggaaaccaauucuguaucaaaauucucaauccuuauaugcccuccgucguggagacccuggagcagaugcagcggaagcacggcggcaugcuuguuagaaacccucugagccgcaauucuacacaugaaauguacuggguguccugcgggacgggaaacaucgucagcgcggugaauaugaccucucggaugcuccugaacagauuuacaauggcccaccgcaaacccaccuaugagcgggauguggaccugggcgcugggacaagacacgucgccguugaaccggagguggcuaaccucgauaucauuggacagcgcaucgaaaauauuaagcaugagcacaaauccaccuggcauuacgacgaggauaacccuuauaagacgugggccuaccacggcagcuaugaagugaagcccuccgggagcgcuucuagcauggucaauggagugguuaaacugcuuaccaagcccugggacgugaucccuauggucacacaaauugccaugaccgauacaacccccuucggccagcagagaguguuuaaagagaagguugacacacggaccccuaaagcgaagcgcggcacggcccaaaucauggaagugacagcuaaguggcuguggggguuccucuccagaaacaaaaagccgcggaucuguaccagagaggaauuuacccggaaaguccgcucuaaugccgcuauuggagccguguucguugacgagaaccaguggaauagcgccaaggaggcgguggaagaugagagauuuugggaccugguccaucgggaacgcgagcuucacaaacagggcaagugcgcuacaugcguguacaacaugauggggaagagagagaagaagcugggagaguucggcaaagccaaggggucccgggccaucugguacauguggcucggcgcucgcuuccuggaguuugaagcccugggauucaugaaugaggaucacugguuuucuagagaaaacagccucuccggcgucgagggggagggacugcauaaacuuggcuauauucugcgggacaucucuaagauuagcgggggaaauauguacgcugaugacacggccggcugggauacccgcaucacagaagacgaucuccagaacgaggcgaaaaucaccgacauuauggaacccgagcacgcccugcuugcuaauuccaucuucaagcugacauaucaaaacaaggugguuagagugcagcggccugccaaaaaugggaccgucauggaugugauuagccgcagagaccagcggggcucuggacaggugggcacauacgggcucaacaccuuuacgaacauggaagcucaacugauccgccagauggaguccgagggaauuuucagccccucugaacuggagaccccuaaucucgccgaaagaguucuggauuggcuugagaagcauggcguggaacggcugaaaagaauggcgaucuccggggacgacugugucgugaagcccaucgaugaccgcuuugccacagcucucaccgcccugaacgauaugggaaaaguucggaaggacauuccgcagugggagccuagcaagggcuggaaugauuggcagcaagugcccuucugcucccaccacuuucaucagcuuaucaugaaagacgggagagagauugucgugccuugucgcaaccaggaugaacuggucggccgggcuagagugucucagggagccggcuggagccuccgcgagacagcuugccuggggaaguccuaugcccaaauguggcagcugauguacuuccaccggagagaccuccgccuggcggccaaugcuaucuguagcgccguucccguggauugggucccuaccucucggacgacaugguccauucaugcccaccaucaguggaugaccacagaagacaugcuuagcguguggaacagaguuuggaucgaggaaaaucccuggauggaggauaaaacccacauuucuagcugggaggacgugccguaucugggaaagcgcgaagaccaauggugcggcucccucaucgggcugacggcucgggccaccugggcgacaaacauccaggucgcuauuaaucaggugagacggcuuaucggaaacgagaauuaccuggauuacaugaccucuaugaaaagauuuaagaacgaaagcgacccugagggcgcccucugguga

SEQ ID NO: 18578 - RNA, 9879 nt, Artificial Sequence
  derived and/or modified CDS sequence (opt5) from DENV-1__HM488255__SS-prME
agcgugaccaugcugcucaugcugaugcccaccgcccuugcuuuccaccugacgaccagaggcggggagccucauaugaucgucuccaagcaggaacgggggaaaucucuccuguuuaagaccagcgccggcguuaauaugugcacccuuaucgcgauggaccugggggagcucugugaagauacaaugaccuacaaaugcccgcgcaucacagaggcugaacccgacgauguggacuguuggugcaaugccaccgauacgugggugaccuaugggacauguucccaaaccggcgagcacagacgggacaagcgcucugucgcccuggcuccucauguggggcugggacucgagacaagaaccgaaacguggaugagcuccgagucugccuggaaacagauucagcggguugaaacaugggcucugcgccaccccggcuucaccgugaucgcccuuuuucuggcgcaugccauuggcacaagcaucacccagaaggggaucauuuucauccuccugaugcuugucaccccuuccauggcuaugagaugcgugggaauuggcagccgggauuuuguugaggggcugucuggagccacauggguggacgucgugcucgagcacggcuccugugugacgaccauggcuaaggauaaacccacacuggacaucgaacugcucaagaccgaggucacaaacccugccauucugcgcaaacuuugcaucgaagcgaagauuagcaauaccacgacagauucuagauguccgacccaaggggaggccacccugguugaagaacaagacgcuaacuucgugugccggcgcacauuuguggauagaggauggggcaauggcuguggacucuucggaaaaggcucccugauuaccugcgccaaguuuaagugcgucacaaaacuugaggggaagaucgugcaguacgaaaaccugaaauauagcguuauugugacgguccacaccggagaccagcaucaagugggcaaugagucuacagaacacgggaccacagcuaccaucacgccccaggccccuaccacagagauucagcucaccgacuacggagcccugacacuggauuguagcccccggaccggccucgacuucaacgaaaugguucugcuuacgaugaaggagaaaagcuggcuggugcauaagcagugguuucucgaucugccucuucccuggacauccggcgcuucuaccagccaagagacauggaaucgccaggaccugcucgucaccuucaaaaccgcgcacgccaagaagcaggaaguggucgugcuggggucccaagagggagcuaugcacacagcccugacgggcgccaccgaaauccagacaagcgggaccacaaccauuuuugcuggacaucucaaaugcagacugaagauggauaaacuuacgcugaagggcaugucuuauguuauguguacaggguccuucaaacucgagaaggaaguggccgagacccagcacggcaccguccuggugcagaucaaguacgagggaacagacgcgccgugcaaaaucccuuucagcacccaagaugaaaagggcguuacacagaacgggcggcugauuacggcuaaucccaucgugaccgacaaagagaagccugucaacauugaagccgagccgcccuuuggagagucuuauaucgugauuggcgccggggaaaaagcucuuaagcucagcugguucaagaaaggauccucuaucggcaagauguuugaggccacagcuagaggggcccgccggauggcgauccugggcgauaccgccugggacuucggaagcauuggcgggguguuuacauccguuggaaaacugguccaucagaucuucggcaccgcuuacggggugcucuuuagcggagugucuuggacgaugaagauuggcaucgggguccugcuuaccuggcugggccucaauuccagaagcacaucucuguccaugaccuguauugccgugggacugguuacacuuuaccucggcgugaugguccaggcugauagcgggugcgugaucaacuggaaaggacgcgaacugaaguguggcuccgggauuuucguuaccaaugaggugcacacauggaccgaacaauauaaguuucaggccgacucuccuaaacggcugagcgcggccaucggaaaggcuugggaggagggcgucugcgggaucagauccgccacgcgccucgaaaacauuauguggaaacagaucucuaacgagcugaaucauauucuucuggaaaacgacaugaaguucacagugguugugggcgaugucgcuggaauccucgcccagggcaaaaagaugauucggccgcaacccauggaguacaaauauagcuggaaguccugggggaaggccaaaaucaucggagcugacgugcagaauaccaccuuuauuaucgauggcccuaacacacccgaauguccugacgaucagagagcguggaauauuugggagguggaggacuacggguucggaaucuuuaccacgaacauuuggcugaagcugcgcgauagcuauacacaggucugcgaccaccggcuuaugucugccgcuaucaaagauuccaaggccguucacgccgacaugggcuacuggaucgaaagcgagaaaaaugaaaccuggaagcucgcuagagccucuuucauugaggugaagacauguaucuggcccaaaucccauacccuguggagcaacggcgugcuggaaucugagaugauuaucccgaagauuuaugggggaccuaucagccaacacaauuaccgccccggcuacuucacacagaccgcggggccuuggcaucucggaaaacuggagcuugauuuugaccugugcgaaggcacgaccgucgugguugaugagcacugcgggaaccggggacccucccucagaacaaccacagugaccggcaagaucauucacgaaugguguugccggagcuguacgcugccuccccugcgcuucagaggcgaggacgggugcugguauggaauggagauccggccggucaaagaaaaggaggaaaaucuugugaagucuaugguuuccgcuggcagcggggagguggacuccuuuucucucggacugcuguguauuagcaucaugauugaagaggucaugagaucccgcuggucucggaaaaugcucaugacaggcacccuggccguguuccuucugcucaucauggggcagcugacauggaacgaucugauuagacuuugcaucaugguuggagccaaugcuagcgaccgcaugggcaugggcaccaccuaccuggcccucauggcgacauuuaagaugagaccuauguucgcuguggggcugcucuuucggcgccugacguccagagagguccuucugcucaccaucggacugucucugguggccagcguggaacuucccaacucccuggaggaacucggcgaugggcuggccaugggaauuaugauccucaaacugcuuacagacuuccaaagccaucagcugugggcuacccuccugucucugacauuuauuaagaccacguucucccuucacuaugccuggaaaacaauggcuaugguccugagcaucguuucucucuuuccccugugucucuccaccaccagccagaagacaaccuggcugccugugcuucugggcucucuggggugcaagccgcucacaauguuccugauugccgagaauaaaaucuggggacggcgcuccuggccccuuaacgaaggcaucauggcggugggcauugucagcauccugcucuccagccugcucaagaacgaugugccucuggccgggccccuuauugcuggaggcaugcugaucgccuguuacguuauuucugggagcuccgcugaccugucucucgagaaagccgccgaggugagcugggaagaggaagcugagcauuccggagcgucucacaauauccuggucgaagugcaggaugacggcacgaugaagaucaaagaugaggagagagacgauacccuuacaauucugcucaaggccacccugcucgcuguuagcgggguguauccucuguccauccccgccacacuuuuugucugguacuucuggcagaagaagaagcagcggucuggagugcugugggacaccccuuccccucccgaagucgagcgcgccgugcuggaugacggcauuuauagaaucaugcagcggggccuccuggggcgcucccagguuggagugggcgucuuccaagaaaacguguuucauacgauguggcacguuaccagaggggcugugcuuauguaccagggaaaacggcuggagcccagcugggccucugucaagaaagaccucauuuccuacggcgggggauggagacugcagggcagcuggaauacaggcgaggaagugcaagugaucgcgguugagcccgggaagaacccuaaaaauguccaaaccgcucccggaacauucaagaccccggaaggcgaggugggggccauugcccucgauuuuaagccuggaacaucuggcucccccaucgugaaccgcgaagggaaaaucgucggacuguauggcaauggcgugguuacgaccagcgggacauacguguccgcuauugcccaggcgaaggcuucucaggagggaccucuucccgagaucgaagacgaggucuuccggaaaagaaaccugaccauuauggaucugcaccccggcagcgggaagacccgccgguaucucccugccaucgugagagaagccauuaaacgcaagcugcggacacuuauccuggcuccgacgagaguuguggccuccgagauggcugaagcccucaagggaaugcccauccgcuaccaaaccacagcggucaaaagcgagcauaccggcaaggagauuguggaccugaugugccacgccacauuuaccaugcggcugcucucuccuguuagagugcccaauuauaacaugaucauuauggaugaagcucauuucacggacccuuccagcaucgccgcucggggguacauuucuacacgcgucggcaugggagaggccgccgcuaucuuuaugaccgcgacacccccuggcagcguggaagccuucccgcaguccaaugcugugauccaggaugaggaaagagacauucccgagcggucuuggaacagcggguaugaguggaucacagauuuuccuggaaaaaccgucugguucguucccuccauuaagucuggcaaugacaucgccaacugucuucgcaaaaaugggaagagagugauucagcugagccggaagacauuugauaccgaauaccagaaaacgaagaacaacgacugggacuacguggucacaaccgauaucuccgagaugggagccaauuucagagcugaccgcgugauugauccucggagaugccugaaacccguuauccucaaggacggcccggaacgcgugauccuggccgggccuaugcccgucacaguggcgagcgcugcccagcggagaggccgcauuggacggaaccacaauaaagagggcgaucaguauaucuacauggggcagccccuuaacaaugacgaggaucaugcccacuggaccgaagcuaagaugcugcucgacaacauuaauacgccugagggaaucauucccgcccuguucgaaccugagagagaaaagucugcggccaucgauggcgaguaucgccugagaggggaggcucggaaaaccuuuguugaacucaugcgcagaggagaccuuccgguguggcuguccuacaaggucgccagcgagggcuuccaauauuccgaucggcgcuggugcuuugacggggaaagaaacaaucaggugcuggaggaaaacauggaugucgagaucuggacaaaagagggcgaacggaagaaacucagaccccgcuggcuggacgcucggaccuacucugacccucuugcccugagagaguucaaggaauuugcugccggacgccggagcguguccggcgaucucauucuggagaucgggaaacugccccagcaccucacacagagagcgcaaaaugcccuugacaaccugguuaugcugcauaauucugaacagggaggccgggcuuaucgccacgccauggaggagcucccugauaccauugaaacacugaugcuucuggcucucaucgccgugcugaccgggggagugacgcuguucuuucucagcggcagaggccuugggaagacauccauuggacugcugugugucauggccagcucuguucuccuguggauggcuuccguggagccccauuggaucgcggccagcaucauucuugaguucuuucugauggugcuccugaucccggagccugaccggcagcgcacaccccaggauaaccaacuggcuuacgucgugauuggccuccuuuucaugauccugaccguugccgccaaugagauggggcugcucgaaacaaccaagaaagaccugggaauuggccacguggcugucgggaaccaccaucacgccgcgaugcuugauguggaccugcauccugccucugcuuggacacucuacgccgucgcuacgaccaucauuacacccaugaugagacacaccaucgagaacacaaccgccaauaucucccugacggcgauugccaaccaggcugccauccugaugggacucgauaagggcuggccuauuagcaaaauggacaucggcgugccccuucuggcucuggggugcuauucucagguuaauccgcucacccugacagccgcugugcuuaugcuggucgcccauuacgcgauuaucggaccuggccuccaagccaaggcuacccgggaagcccagaaacgcacagcugccgggaucaugaagaaccccaccguggauggaauuguugccaucgaccuggaucccguggucuaugacgcgaaguuugagaaacagcugggccagauuaugcuccuuauccuguguacgagccaaauucugcucaugagaacaaccugggcucugugcgaauccaucacacuugccaccgggccucugaccacacucugggagggaucuccgggcaaguucuggaauacgaccaucgcugugagcauggccaacauuuuucggggcuccuaccuggccggggcuggacuggccuucagccucaugaaaucccuuggccgcgggagacggggaacaggcgcgcagggggagacccugggagaaaaguggaaaagacagcugaaucagcucucuaagagcgaguucaacacauauaagcgcuccggcaucauggaaguggaccggucugaggccaaagaaggccugaagagaggggagaccacgaaacacgcuguuagccgcggaacagccaaacuucggugguuugucgagagaaaucuggugaaacccgaaggcaaggugauugaucucggguguggacgcggcgggugguccuacuauugcgcuggacugaagaaagucaccgagguuaagggcuacaccaaaggcgggccuggacacgaagaacccaucccuauggccacauacggcuggaaccuggugaagcuccauucugggaaagacguguucuuuauucccccugaaaagugugauacccuucugugcgacaucggagagagcuccccgaaucccacaauugaggaaggccggacgcugagaguccucaaaaugguggagccuuggcugcgcgggaaccaauucuguaucaagauccuuaaucccuauaugccuagcguuguggaaacccuggagcagaugcagcggaagcacggaggcaugcucgucagaaacccccugucucgcaauuccacacaugagauguacugggugagcugcggcaccgggaacauuguuucugcggugaauaugacaucccggaugcugcucaacagauuuaccauggcccaccgcaaaccgacguaugaaagagaugucgaccugggagcuggcacccggcacguggccguggagccugaagucgcuaaccuugauaucauugggcagcgcaucgagaauauuaagcaugaacacaaaagcacauggcauuacgacgaggauaaccccuauaagaccugggccuaccacggaucuuaugagguuaaacccuccggcagcgcuuccagcauggugaaugggguggucaagcugcucacaaagccuugggacgugauccccaugguuacccaaaucgccaugacagauaccacgccuuucggacagcagagaguguuuaaagaaaaggucgacacacggaccccgaaagcgaagagaggcaccgcccaaauuauggaggugacagcuaaauggcuguggggcuuccuuucucggaacaagaagccccgcaucuguacgagagaagaguuuacccggaaaguucgcagcaaugccgcuauuggggccguguucgucgacgaaaaccaguggaacuccgccaaggaggcgguggaggaugaaagauuuugggaccugguucaucgggagcgcgaacuccacaaacagggaaagugcgcuacaugcguguacaacaugaugggcaaaagagagaagaagcugggggaguucggaaaagccaagggcucucgggccaucugguacauguggcugggggcucgcuuucucgaguucgaggcccugggcuucaugaaugaagaucacugguuuagcagagagaacucccuuucuggagucgaaggcgaggggcugcauaaacucggauauauucugcgggacaucagcaagaucccuggcgggaauauguacgcugaugacaccgccggaugggauacacgcauuaccgaggacgaucuucagaacgaagcgagaaucacagacauuauggagcccgaacacgcccugcucgcuaaauccaucuucaagcugaccuaucaaaauaaagugguccgggugcagcgcccugccaagaacggcacgguuauggaugugauuucuagacgggaccagagagggagcggccaggucggaaccuacggccugaauacauuuaccaacauggaggcucaacucauccgccagauggaauccgaggggaucuucagccccucugagcuggaaacaccgaaccuugccgagcgggugcuggauuggcucgaaaaguauggaguggagagacugaaacgcauggcgauuuccggcgacgacuguguugugaagccuaucgaugaccgguuugccaccgcucuuacggcccugaaugauauggggaaagucagaaaggacauuccccagugggaaccuagcaaaggauggaacgauuggcagcaagugcccuucugcucucaucacuuucaccagcucaucaugaaggacggccgcgagauuguugugccuugucggaaucaggaugagcuggucgggagagcucgcgugucccagggcgccggauggagccugcgggaaacagcuugccucggcaaguccuacgcccaaauguggcagcugauguauuuccauagacgcgaccuucggcuggcggccaacgcuaucuguucugccguccccguggauuggauuccgaccagcagaacaaccugguccauccacgcccaucaccaguggaugacgaccgaggacaugcucagcguuuggaaucggguguggaucgaagagaacccuuggauggaagauaaaacacauauuucuuccuggggagacguccccuaccugggaaagagagaggaccaauggugcggcagccuuaucgggcugaccgcucgcgccacaugggcgaccaauauucagguggcuaucaaccagguucggagacucauuggaaaugagaacuaccuggauuauaugacaucuaugaaacgcuuuaagaaugaaagcgaccccgagggcgcccugugguga

SEQ ID NO: 18579 - RNA, 9879 nt, Artificial Sequence
  derived and/or modified CDS sequence (opt5) from DENV-1__HM181944__SS-prME
uccgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaacucugugaagauacaaugaccuacaaaugcccgcgcaucuccgaggcugaacccgacgauguggacuguuggugcaaugccacagauaccugggugacguauggaaccuguucucaaacaggcgagcacagacgggacaagcgcagcgucgcccuggcuccucauguggggcugggacucgagaccagaacagaaaccuggauguccucugagggcgccuggaaacagauucagcggguugaaacgugggcucugcgccaccccggcuucacagugaucgcccuuuuucuggcgcaugccauugggaccagcaucacacagaagggaaucauuuucauccuccugaugcuugucaccccuuccauggcuaugagaugcgugggcauugggagccgggauuuuguugagggacugucuggcgccaccuggguggacgucgugcucgagcacggguccugugugacaacgauggcuaaggauaaacccacccuggacaucgaacugcucaagacagaggucaccaacccugccguucugcgcaaacuuugcauugaagcgaagaucagcaauacaaccacggauucuagauguccgacacaaggagaggccacccugguggaagaacaagacgcuaacuucgugugccggcgcaccuuugucgauagaggcuggggcaauggguguggacucuucggcaaagggucccugauuacaugcgccaaguuuaagugcgugaccaaacuugagggaaagaucguucaguacgaaaaccugaaauauagcgugaucgucacagugcacacgggcgaccagcaucaaguugggaaugagucuaccgaacacggaacaaccgcuacaauuacaccccaggccccuuccacggagauccagcucaccgacuacggcgcccugacacuggauuguagcccccggaccggccucgacuucaacgaaauggugcugcuuacaaugaaggagaaauccuggcugguccauaagcagugguuucucgaucugccucuucccuggaccucuggggcuagcacgucccaagagacauggaaucgccaggaccugcucgugaccuucaaaacagcgcacgccaagaagcaggaagucgugguucugggaagccaagagggcgcuaugcacaccgcccugaccggggccacagaaauucagacgucuggaaccacaaccaucuuugcuggccaucucaaaugcagacugaagauggauaaacuuacacugaaggggauguccuaugugauguguaccggcagcuucaaacucgagaaggaagucgccgagacgcagcacggaacagugcugguucagauuaaguacgagggcaccgacgcgccgugcaaaaucccuuucucuacccaagaugaaaagggggugacacagaacggacggcugaucaccgcuaaucccauugucacagacaaagagaagccugugaacaucgaagccgagccgcccuuuggcgagagcuauauugugaucggggccggagaaaaagcucuuaagcucuccugguucaagaaaggcucuagcauugggaagauguuugaggccacggcuagaggcgcccgccggauggcgauccugggagauaccgccugggacuucggcuccaucgggggaguuuuuacaagcgucggcaaacuggugcaucagauuuucgggaccgcuuacggagugcucuuuucuggcgucuccuggacaaugaagaucgggauuggcgugcugcuuaccuggcugggacucaauagcagaucuacgucccugagcaugaccuguaucgccguuggccuggugacacuuuaccucggggucauggugcaggcugauuccggaugcguuauuaacuggaaaggccgcgaacugaagugugggucuggaaucuucgugaccaaugagguccacacauggaccgaacaauauaaguuucaggccgacagcccuaaacggcuguccgcggccauuggcaaggcuugggaggagggggugugcggcaucagaucugccacacgccucgaaaacaucauguggaaacagauuagcaacgagcugaaucauauccuucuggaaaacgacaugaaguucaccguuguggucggagauguggcuggcauucucgcccaggggaaaaagaugauccggccgcaacccauggaguacaaauauuccuggaaaagcuggggaaaggccaagauuaucggcgcugacgugcagaauacgacauuuaucauugaugggccuaacacccccgaauguccugacgaucagagagcguggaauaucugggaggucgaggacuacggauucggcauuuuuaccacaaacaucuggcugaagcugcgcgauucuuauacccagguuugcgaccaccggcuuauguccgccgcuauuaaagauagcaaggccgugcacgccgacaugggcuacuggaucgaaucugagaaaaaugaaacguggaagcucgcuagagccuccuucaucgaggugaagacauguauuuggcccaaaagccauacccuguggucuaacgggguccuggaaagcgagaugaucauuccgaagaucuauggaggcccuauuucccaacacaauuaccgccccggguacuucacacagaccgcgggaccuuggcaucucggcaaacuggagcuugauuuugaccugugcgaagggacaaccgugguuguggaugagcacugcggaaaccggggccccagccucagaacgaccacagucaccggcaagaucauccacgaaugguguugccggucuuguacacugccuccccugcgcuucaaaggggaggacggaugcugguauggcauggagauuagaccggugaaggaaaaggaggaaaaucuuguuaaauccauggugagcgcuggguccggagaggucgacucuuuuagccucggccugcuguguaucuccauuaugaucgaagaggugaugcggucuagauggagccgcaagaugcucaugaccgggacgcuggccguuuucuuucuucugauuaugggacagcucacauggaacgaucugauccggcugugcauuauggugggcgccaaugcuuccgacagaaugggcauggggaugaccuaccuugcccugauggcgacauucaaaaugcgcccuauguuugcugucggacuccuguucagacggcucaccucucgcgaggugcugcuucugaccaucggccucagccugguggccuccgucgaacugcccaacagccuugaggaacugggggauggacucgccaugggcaucaugauucugaagcuccugacagacuuucaaucucaucagcuuugggcuacgcugcucucccugaccuucaucaaaacaaccuuuagccugcacuaugccuggaagacaauggcuaugguucuuucuauugugucccuguucccccucugucugagcaccacgucucagaagacaaccuggcucccugugcugcuugggucccugggaugcaaaccgcugaccauguuucucaucgccgagaauaagauuuggggcagaaaaagcuggccccugaacgaaggcaucauggcggucgggaucguguccauucuucugagcucucuccugaagaacgauguuccucucgccggaccccugaucgcuggcgggaugcuuauugccuguuacgugaucagcggauccucugcugaccugagccuggagaaagccgccgaggucuccugggaagaggaagcugagcauucuggcgcgagccacaauauucucguggaaguucaggaugacgggacaaugaagaucaaagaugaggagcgggacgauacccugacaauccuucugaaggccacgcuccuggcuguguccggagucuauccucucucuauucccgccacccuguucgugugguacuucuggcaaaagaaaaagcagcgcagcggcguccuuugggacacaccuagcccucccgaaguggagagagccguucuggaugacggcaucuaucggauuaugcagcgcgggcugcucggaagaagccaggugggcgucgggguguuucaagaaaacguuuuccauaccauguggcacgugacacggggagcuguccugauguaccagggcaaacgccuugagcccucuugggccuccgugaagaaagaccugaucagcuacgggggaggcuggagacuccagggcucuuggaauaccggggaggaagugcagguuauugcggucgagcccggaaagaacccuaagaaugugcaaacggcucccggcaccuuuaaaacauccgaaggggaggugggagccaucgcccuggauuucaagccgggcaccagcggguccccuauugucaaccgggaaggaaaaaucgugggccucuauggcaaugggguugugacaaccucuggaacauacgucagcgcuaucgcccaggcgaaggcuucccaggagggcccccugccugagauugaagacgagguguuuagaaaacgcaaccuuacgaucauggaucugcaccccgggagcggaaagacccggagauaucugcccgccauuguucgcgaagccaucaagcggaaacucagaacacugauucuugcuccuacccgcguggucgccucugagauggcugaagcccugaagggcaugccgauccgguaccaaaccacagcggugaaauccgagcauacggggaaggagaucguugaccucaugugccacgccaccuucacaaugagacugcugagccccgugcgcgucccuaauuauaacaugauuaucauggaugaagcucauuuuaccgaccccucuagcauugccgcucggggcuacaucuccacaagagugggaaugggcgaggccgccgcuauuuucaugaccgcgacgccucccgggucuguggaagccuuuccucagagcaaugcugucauccaggaugaggaacgggacaucccggagcgcuccuggaacucuggauaugaguggauuacagauuuccccggcaaaaccguuugguuugugccuagcaucaaguccgggaaugacauugccaacugucucagaaagaauggaaaacgggugauccagcuuagccgcaagaccuucgauacagaauaccagaaaaccaagaacaacgacugggacuacgucgugacaaccgauauuucugagaugggcgccaauuucagagcugaccggguuaucgaucccagacgcugccugaaaccugugauucugaaggacgggcccgaacgggucauccucgccggcccgaugccugugacgguugcguccgcugcccagagacgcggacggaucggcagaaaccacaauaaggagggggaucaguauauuuacaugggacagccccugaacaaugacgaggaucaugcccacuggacagaagcuaaaaugcuucuggacaacaucaauacccccgagggcauuaucccugcccucuuugaacccgagcgcgaaaagagcgcggccauugauggggaguaucggcugagaggagaggcucgcaaaacauucguggaacugaugagacggggcgaccucccugucuggcuuuccuacaagguggccucugagggguuucaauauagcgaucgcagauggugcuucgacggcgaacggaacaaucagguccuggaggaaaacauggauguggagaucuggaccaaagagggagaacgcaagaaacugagaccgcgguggcucgacgcuagaacguacuccgacccccuggcccuucgcgaguuuaaggaguucgcugccggccggagaucuguuagcggggaucugauccucgagauuggaaagcugccucagcaccugacccagcgcgcgcaaaaugcccucgacaaccuugugaugcugcauaauuccgaacagggcgggcgggcuuauagacacgccauggaggagcugcccgauacaaucgaaacccucaugcugcuugcucugauugccgugcucacaggaggcgucacccuguuuuuccugagcggccgggggcucggaaaaacaucuaucggccuucuguguguuauggccuccagcgugcugcucuggauggcuucuguggagccucauuggauugcggccuccaucauccuggaauuuuuccuuaugguccugcucauucccgagccggaccgccagagaaccccucaggauaaccaacuggcuuacgugguuaucgggcugcucuuuaugauucuuacgguggccgccaaugagaugggacugcuggaaacaaccaagaaagaccucggcaucgggcacgucgcuguggagaaccaccaucacgccgcgaugcuggaugucgaccuucaucccgccagcgcuuggacccuguacgccguggcuacaaccauuaucacaccuaugaugcggcacacgauugaaaacaccacagccaauaucucucucaccgcgaucgccaaccaggcugccauucugaugggacuggauaagggcuggcccaucagcaaaauggacauuggcguuccucuccuugcucuggggugcuauucccaggugaauccccugacacucaccgccgcuguccugaugcuuguggcccauuacgcgaucauuggaccgggccugcaagccaaggcuacgcgcgaggcccagaagagaaccgcugccgggaucaugaaaaacccuacaguugauggaaucguggccauugaccucgaucccgucguguaugacgcgaaguucgaaaaacagcugggccagaucaugcugcucauucuuuguaccucucaaauccugcugaugcggacaaccugggcucucugcgagagcauuacgcuggccacagggccccuuaccacacugugggagggauccccuggcaaguuuuggaauaccaccaucgcugugagcauggccaacaucuuccgcggcuccuaccucgccggggcuggacuggccuucucucugaugaaaagccucggcgggggaagacggggcacaggggcgcagggagaaacgcuuggcgagaaguggaagcgccagcugaaucagcuguccaaaucugaauuuaacaccuauaagagaagcggcauuauggagguugaccgguccgaagccaaagaggggcucaagagaggagagacaaccaaacacgcugucucucgcggcacagccaagcugcggugguucguggaaagaaaucuugugaagccggaggggaaagucaucgaucugggauguggccgcgggggauggagcuacuauugcgcuggccucaagaaaguuaccgaagugaagggcuacacgaaagggggacccggccacgaggaaccuauucccauggccacauacggguggaaccuggugaagcugcauuccggaaaagacgucuuuuucgugccucccgagaagugugauacccuccuuugcgacaucggcgagagcucuccuaauccgaccauugaagaggggcggacacugagaguucugaagaugguggaacccuggcuccgcggaaaccaauuuuguaucaaaauucugaauccuuauaugcccuccgucguggagacccuugagcagaugcagcggaagcacggcggcaugcugguuagaaacccucucagccgcaauucuacacaugaaauguacuggguguccugcgggacgggaaacaucgucagcgcggugaauaugaccucucggaugcugcugaacagauucacaauggcccaccgcaaacccaccuaugagcgggauguggaccucggcgcugggacaagacacgucgccguugaaccggagguggcuaaccuggauaucauuggacagcgcaucgaaaauauuaagcaugagcacaaauccaccuggcauuacgacgaggauaacccuuauaagacgugggccuaccacggcagcuaugaagugaagcccuccgggagcgcuucuagcauggucaauggagugguuaaacuucugaccaagcccugggacgugaucccuauggucacacaaauugccaugaccgauacaacccccuuuggccagcagagaguguucaaagagaagguugacacacggaccccuaaagcgaagcgcggcacggcccaaaucauggaagugacagcuaaguggcucuggggguuucuguccagaaacaaaaagccgcggaucuguaccagagaggaguucacccggaaaguccgcucuaaugccgcuauuggagccguguuuguugacgagaaccaguggaauagcgccaaggaggcgguggaagaugagagauucugggaccuuguccaucgggaacgcgagcugcacaaacagggcaagugcgcuacaugcguguacaacaugauggggaagagagagaaaaagcucggagaguuuggcaaagccaaggggucccgggccaucugguacauguggcugggcgcucgcuuccuggaguucgaagcccucggauuuaugaaugaggaucacugguucucuagagaaaacagccuguccggcgucgagggggagggacuucauaaacugggcuauauucuccgggacaucucuaagauuagcgggggaaauauguacgcugaugacacggccggcugggauacccgcaucacagaagacgaucugcagaacgaggcgaaaaucaccgacauuauggaacccgagcacgcccuucuggcuaauuccaucuuuaagcucacauaucaaaacaaggugguuagagugcagcggccugccaaaaaugggaccgucauggaugugauuagccgcagagaccagcggggcucuggacaggugggcacauacgggcugaacaccuucacgaacauggaagcucaacugauccgccagauggaguccgagggaauuuuuagccccucugaacucgagaccccuaaucuggccgaaagaguucuugauuggcuggagaagcauggcguggaacggcucaaaagaauggcgaucuccggggacgacugugucgugaagcccaucgaugaccgcuucgccacagcucugaccgcccuuaacgauaugggaaaaguucggaaggacauuccgcagugggagccuagcaagggcuggaaugauuggcagcaagugcccuuuugcucccaccacuuccaucagcugaucaugaaagacgggagagagauugucgugccuugucgcaaccaggaugaacucgucggccgggcuagagugucucagggagccggcuggagccugcgcgagacagcuugccuggggaaguccuaugcccaaauguggcagcucauguacuuucaccggagagaccugcgccuugcggccaaugcuaucuguagcgccguucccguggauugggucccuaccucucggacgacaugguccauucaugcccaccaucaguggaugaccacagaagacaugcugagcguguggaacagaguuuggaucgaggaaaaucccuggauggaggauaaaacccacauuucuagcugggaggacgugccguaucucggaaagcgcgaagaccaauggugcggcucccugaucgggcuuacggcucgggccaccugggcgacaaacauccaggucgcuauuaaucaggugagacggcugaucggaaacgagaauuaccucgauuacaugaccucuaugaaaagauucaagaacgaaagcgacccugagggcgcccugugguga

SEQ ID NO: 18580 - RNA, 9879 nt, Artificial Sequence
  derived and/or modified CDS sequence (opt5) from DENV-1__HM181946__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagagcaggacgcuaacuucgugugccggcgcacauuuguggauagaggcuggggcaauggguguggacucuucggcaaagggucucugaucaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagauccgguacgagggcacagacgcgccgugcaagaucccuuucuccacccaagaugaaagagggguuacacagaacggacgccugauuacggcuaaucccaucgugaccgacaaagagaagccugucaacauugaagccgagccccccuuuggcgagagcuauaucgugauuggggccggagaaaaagcucuuaagcucucuugguucaaaaagggcagcuccaucgggaagauguuugaggccacagcucggggcgccagacgcauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucucgguccacaagcuucucuaugaccuguauugccgugggccugguuacacuguaccuuggggugaugguccaggcugauuccggaugcgugaucaacuggaaaggcagagaacucaagugugggagcggaauuuuuguuaccaaugaggugcacacauggaccgaacaauauaaauuccaggccgacuccccuaagcgccugucugcggccaucggcaaggcuugggaggagggggucugcggcauccggagcgccacgagacuggaaaacauuauguggaaacagaucuccaacgagcucaaucauauucugcuugaaaacgacaugaaguuuacagugguugugggagaugucgcuggcauccuggcccaggggaaaaagaugauucgcccgcaacccauggaguacaaauauucuuggcggagcuggggaaaggccaaaaucaucggcgcugacgugcagaauaccaccuucauuaucgaugggccuaacacacccgaauguccugacgaucagagagcguggaauauuugggagguggaggacuacggauuuggcaucuucaccacgaacauuuggcucaagcugcgcgauuccuauacacaggucugcgaccaccggcugaugagcgccgcuaucaaggauucuaaagccguucacgccgacaugggcuacuggaucgaauccgagaagaaugaaaccuggaaacuugcuagagccagcuucauugaggugaagacauguaucuggcccaaaucucauacccucugguccaacggggugcuggaaagcgagaugauuaucccgaagauuuauggaggcccuaucucucaacacaauuaccggcccggguacuuuacacagaccgcgggaccuuggcaucugggcaagcucgagcuggauuucgaccuuugcgaagggacgaccgucgugguugaugagcacugcggaaaccgcggccccagccugagaacaaccacagugaccggcaaaaucauucacgaaugguguugccgguccuguacgcucccuccccugagauuucgcggggaggacggaugcugguauggcauggagauccggccggucaaggaaaaagaggaaaaucuggugaagagcaugguuucugcuggguccggagagguggacagcuucucccuuggccuccuguguauuucuaucaugauugaagaggucaugagaagccgcugguccagaaaaaugcugaugacagggacccucgccguguuucugcuucugaucaugggacagcucacauggaacgaucugauucggcugugcaucaugguuggcgccaaugcuucugaccgcaugggcauggggaccaccuaccuugcccugauggcgacauucaagaugagaccuauguuugcugugggacuccuguuccggcgccucacgagcagagagguccugcuucugaccaucggccucucccugguggccucuguggaacugcccaacagccuugaggaacugggggauggacucgccaugggcauuaugauccugaagcuccugacagacuuucaaucccaucagcuuugggcuacccugcucagccugacauucauuaaaaccacguuuucucugcacuaugccuggaagacaauggcuaugguccuuuccaucguuagccuguucccccucugucugucuaccaccucccagaaaacaaccuggcucccugugcugcuugggagccugggaugcaagccgcugacaauguuucucauugccgagaauaaaaucuggggccggcgcucuuggccccugaacgaaggcaucauggcgguggggauugucuccauccuucugagcucccuccugaagaacgaugugccucucgccggaccccugauugcuggcgggaugcuuaucgccuguuacguuauuagcggaucuagcgcugaccugucccuggagaaggccgccgaggugucuugggaagaggaagcugagcauagcggcgcgucccacaauauccucgucgaagugcaggaugacgggacgaugaaaaucaaggaugaggagagagacgauacccugacaauucuucugaaagccacccuccuggcuguuucuggaguguauccucucagcauccccgccacacuguucgucugguacuucuggcaaaagaaaaagcagcgguccggcgugcuuugggacaccccuucucccccggaagucgagcgcgccgugcuggaugacggcauuuauagaaucaugcagcgggggcugcucggaagaagccagguuggcgugggggucuuucaagaaaacguguuccauacgauguggcacguuacccgcggagcugugcugauguaccagggcaaacggcuugagccuuccugggccagcgucaagaaggaccugauuucuuacgggggaggcuggagacuccagggcuccuggaauacaggggaggaagugcaggugaucgcgguugagcccggaaaaaacccuaagaauguccaaaccgcucccggcacauuuaaaaccccggaaggggaggugggagccauugcccuggauuucaagccuggcacaagcgggucucccaucgugaaccgcgaaggaaaaaucgucggccucuauggcaauggggugguuacgaccuccggaacauacgugagcgcuauugcccaggcgaaggcuucccaggagggcccucugcccgagaucgaagacgaggucuuucggaagagaaaccuuaccauuauggaucugcaccccgggucuggaaaaacccgccgguaucugccugccaucgugagagaagccauuaagcgcaaacuccggacacugauccuugcuccgacgagaguuguggccagcgagauggcugaagcccugaagggcaugcccauccgguaccaaaccacagcggucaaauccgagcauaccgggaaggagauuguggaccucaugugccacgccacauucaccaugcgccugcugagcccuguuagagugcccaauuauaacaugaucauuauggaugaagcucauuuuacggacccuucuuccaucgccgcucggggcuacauuagcacacgcgucggaaugggcgaggccgccgcuaucuucaugaccgcgacccccccugggucuguggaagccuuuccgcagagcaaugcugugauccaggaugaggaaagagacauucccgagcgguccuggaacucuggauaugaguggaucacagauuucccuggcaagaccgucugguuuguucccagcauuaaauccgggaaugacaucgccaacugucucagaaagaauggaaaacgcgugauucagcuuucucggaagacauucgauaccgaauaccaaaaaacgaagaacaacgacugggacuacguggucacaaccgauaucagcgagaugggcgccaauuucagagcugaccgcgugauugauccucggagaugccugaagcccguuauccugaaagacgggccggaacgcgugauccucgccggcccuaugcccgucacaguggcguccgcugcccagcggagaggacgcauuggcagaaaccacaauaaggagggggaucaguauaucuacaugggacagccccugaacaaugacgaggaucaugcccacuggaccgaagcuaaaaugcuucuggacaacauuaauacgccugagggcaucauucccgcccucuuugaaccugagcgggaaaagagcgcggccaucgauggggaguaucgccugagaggagaggcucggaaaaccuucguugaacugaugcgcagaggcgaccucccgguguggcuuucuuacaaggucgccuccgagggguuucaauauagcgaucggagauggugcuucgacggcgaacgcaacaaucaggugcuggaggaaaacauggaugucgagaucuggacaaaggagggagaacggaaaaagcugagaccccgcuggcucgacgcucggaccuacuccgacccucuggcccuuagagaguuuaaagaauucgcugccggccggcgcucugugagcggggaucugauucucgagaucggaaagcugccccagcaccugacacagagagcgcaaaaugcccucgacaaccuuguuaugcugcauaauuccgaacagggcgggcgggcuuaucgccacgccauggaggagcugccugauaccauugaaacacucaugcugcuugcucugaucgccgugcucaccggaggcgugacgcuguuuuuccugucuggcagagggcucggaaaaacaagcauuggccuucugugugucauggccuccagcguucugcucuggauggcuucuguggagccccauuggaucgcggccuccaucauucuggaauuuuuccuuauggugcugcucaucccggagccugaccggcagcgcaccccccaggauaaccaacuggcuuacgucgugauugggcugcucuuuaugauccuuaccguugccgccaaugagaugggacugcuggaaacaaccaagaaagaccucggcauugggcacguggcugucggaaaccaccaucacgccgcgaugcuggauguggaccuucauccugccagcgcuuggacacuguacgccgucgcuacgaccaucauuacacccaugaugagacacaccaucgagaacacaaccgccaauaucucucucacggcgauugccaaccaggcugccauccugaugggccuggauaagggcuggccuauuuccaagauggacaucggggugccccuccuugcucugggaugcuauagccagguuaauccgcugacccucacagccgcugugcugaugcuugucgcccauuacgcgauuaucggcccugggcugcaagccaaagcuacccgggaagcccagaagcgcacagcugccggaaucaugaaaaaccccaccguggauggcauuguugccaucgaccucgaucccguggucuaugacgcgaaguucgagaaacagcuggggcagauuaugcugcucauccuuuguacgucucaaauucugcugaugagaacaaccugggcucucugcgaaagcaucacacuggccaccggaccucuuaccacacugugggagggcuccccgggcaaguuuuggaauacgaccaucgcugugucuauggccaacauuuuccgggggagcuaccucgccggagcuggccuggccuucucccugaugaagagccucgggggaggcagacgcgggacaggagcgcagggcgagacccuuggcgaaaaauggaagcggcagcugaaucagcuguccaaaucugaguuuaacacauauaagagaagcgggaucauggaaguggaccgcuccgaggccaaagaaggacucaagcggggcgagaccacgaagcacgcuguuucuagagggacagccaaacugcgcugguucgucgagcggaaucuugugaagcccgaaggaaaagugauugaucugggcugugggagaggaggcuggagcuacuauugcgcuggccucaagaaagucaccgagguuaagggguacaccaagggaggcccugggcacgaagagcccaucccuauggccacauacggauggaaccuggugaaacugcauuccggcaaggacguguuuuucguccccccugaaaaaugugauacccuccuuugcgacauuggggagucuagcccgaaucccacaaucgaggaaggacgcacgcugcgggugcugaagaugguugagccuuggcucagaggcaaccaauuuuguauuaaaauccugaaucccuauaugccuuccguggucgaaacccuugagcagaugcagcgcaagcacggcgggaugcuggugcggaacccccucagcagaaauucuacacaugagauguacuggguuuccugcggaaccggcaacaucgugagcgcggucaauaugacaucucgcaugcugcugaacagauucaccauggcccaccggaaaccgacguaugaacgcgauguggaccucggggcuggaaccagacacguggccgucgagccugaaguugcuaaccuggauauuaucggccagcggauugagaauaucaagcaugaacacaaguccacauggcauuacgacgaggauaaccccuauaaaaccugggccuaccacgggagcuaugaggugaagcccucuggauccgcuagcuccauggugaauggcgucgugaaacuucugacaaagccuugggacguuauucccauggugacccaaaucgccaugacagauaccacgccuuuuggccagcagagagucuucaaagaaaagguggacacacggaccccgaaggcgaaacgcgggaccgcccaaaucauggagguuacagcuaaguggcucuggggauuucugagcagaaacaaaaagccccggauuuguacgcgcgaagaguucaccagaaaagugcggucuaaugccgcuaucggcgccgucuuuguggacgaaaaccaguggaauagcgccaaggaggcgguugaggaugaacgcuucugggaccuugugcauagagagcgggaacugcacaagcaggggaaaugcgcuacaugcgucuacaacaugaugggaaagcgcgagaaaaagcucggcgaauuugggaaagccaagggcuccagagccauuugguacauguggcugggagcucgguuccuggaguucgaggcccucggcuuuaugaaugaagaucacugguucucucgcgagaacagccuguccgggguggaaggagagggccuucauaagcugggguauauccucagagacauuucuaaaaucccuggaggcaauauguacgcugaugacaccgccgggugggauacacggaucaccgaggacgaucugcagaacgaagcgcgcauuacagacaucauggagcccgaacacgcccuucuggcuaagagcauuuuuaaacucaccuaucaaaauaaggucgugagaguucagcggccugccaaaaacggcacggugauggaugucaucuccagacgcgaccagcggggaucuggccagguggggaccuacggacugaauacauucaccaacauggaggcucaacugauuagacagauggaaagcgagggcaucuuuucccccagcgagcucgaaacaccgaaccuggccgagcgcgugcuugauuggcuggaaaaguaugggguugagcggcucaaaagaauggcgaucucuggagacgacuguguggucaagccuauugaugaccgcuucgccaccgcucugacggcccuuaaugauaugggcaaggugcggaaagacaucccccagugggaaccuuccaagggguggaacgauuggcagcaaguucccuuuugcagccaucacuuccaccagcugauuaugaaagacggcagagagaucguggucccuugucgcaaucaggaugagcucgugggacgggcuagagucucucagggcgccggguggucccugcgcgaaacagcuugccugggaaagagcuacgcccaaauguggcagcucauguauuuucaucggagagaccugcggcuugcggccaacgcuauuuguuccgccgugcccguugauuggaucccgaccucuagaacaaccuggagcauucacgcccaucaccaguggaugacgaccgaggacaugcuguccguguggaaucgcgucuggaucgaagagaacccuuggauggaagauaaaacacauaucagcucuuggggcgacgugcccuaccucgggaagcgggaggaccaauggugcggaucccugauuggccuuaccgcuagagccacaugggcgaccaauauccagguugcuauuaaccaggugcgcagacugaucgggaaugagaacuaccucgauuauaugacaagcaugaagcgguucaaaaaugaaucugaccccgagggcgcccugugguga

SEQ ID NO: 18581 - RNA, 9879 nt, Artificial Sequence
  derived and/or modified CDS sequence (opt5) from DENV-1__HM181948__SS-prME
agcgugaccaugcugcucaugcugaugcccacagcccuugcuuuccaccugacgaccagaggcggggagccucauaugaucgucuccaagcaggaacggggaaaaucucuccuguuuaagaccagcgccggcguuaacaugugcacccuuaucgcgauggaccugggggagcucugugaagauacaaugaccuacaaaugcccccgcaucacagagguggaacccgacgauguggacuguuggugcaaugcuaccgauacgugggucaccuauggaacauguucccaaaccggcgagcacagacgggacaagcgcucuguggcccuggccccucauguugggcugggacucgagacaagaaccgaaacguggaugagcuccgagggcgcuuggaaacagauucagcggguggaaacaugggcccugcgccaccccggcuucaccgucaucgcucuuuuucuggcccaugcgauugggacaucuaucacccagaagggaaucauuuucauccuccugaugcuugugaccccuagcauggccaugagaugcguuggcauugggucccgggauuuuguggagggacugagcggcgcuacaugggucgacguggugcucgagcacgggucuugugucacgaccauggccaaggauaaacccacacuggacaucgaacugcucaagaccgagguuacaaacccugcuauucugcgcaaacuuugcaucgaagccaagauuuccaauaccacgacagauagcagauguccgacccaaggagaggcgacccugguggaagaacaagacgccaacuucgugugccggcgcacauuugucgauagaggcuggggcaauggguguggacucuucggcaaagggucucugauuaccugcgcuaaguuuaagugcgugacaaaacuugagggaaagaucguucaguacgaaaaccugaaauauuccgugauugucacggugcacaccggcgaccagcaucaaguugggaaugagagcacagaacacggaaccacagccaccaucacgccccaggcuccuaccacagagauucagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggccuccaccucucaagagacauggaaucgccaggaccugcucgugaccuucaaaaccgcucacgcgaagaagcaggaagucgugguucugggaagccaagagggcgccaugcacacagcucugacgggggccaccgaaauccagacauccggaaccacaaccauuuuugccggccaucucaaaugcagacugaagauggauaaacuuacgcugaaggggaugagcuaugugauguguacaggcucuuucaaacucgagaaggaagucgcugagacccagcacggaaccgugcugguucagaucaaguacgagggcacagacgccccgugcaaaaucccuuucuccacccaagaugaaaagggggugacacagaacggacggcugauuacggcgaaucccaucgucaccgacaaagagaagccugugaacauugaagcugagccgcccuuuggcgagagcuauaucgugauuggggccggagaaaaagcccuuaagcucucuugguucaagaaaggcagcuccaucgggaagauguuugaggcuacagccagaggcgcucgccggauggccauccugggagauaccgcgugggacuucggcucuauugggggaguuuuuacaagcgucggcaaacuggugcaucagaucuucgggaccgccuacggagugcucuuuuccggcgucagcuggacgaugaagauugggaucggcgugcugcuuaccuggcugggacucaauucuagauccacaagccugucuaugaccuguauugcuguuggccuggugacacuuuaccucggggucauggugcaggccgauuccggaugcguuaucaacuggaaaggccgcgaacugaagugugggagcggaauuuucgugaccaaugagguccacacauggaccgaacaauauaaguuucaggcugacuccccuaaacggcugucugccgcgaucggcaaggccugggaggagggggugugcggcaucagaagcgcuacgcgccucgaaaacauuauguggaaacagaucuccaacgagcugaaucauauucuucuggaaaacgacaugaaguucacaguuguggucggagauguggccggcauccucgcucaggggaaaaagaugauucggccgcaacccauggaguacaaauauucuuggaaaagcuggggaaaggccaagaucaucggcgccgacgugcagaauaccaccuuuauuaucgaugggccuaacacacccgaauguccugacgaucagagagcuuggaauauuugggaggucgaggacuacggauucggcaucuuuaccacgaacauuuggcugaagcugcgcgauuccuauacacagguuugcgaccaccggcuuaugagcgcggccaucaaagauucuaaggcugugcacgccgacaugggcuacuggaucgaauccgagaaaaaugaaaccuggaagcucgccagagcuagcuucauugaggugaagacauguaucuggcccaaaucucauacccugugguccaacgggguccuggaaagcgagaugauuaucccgaagauuuauggaggcccuaucucucaacacaauuaccgccccggguacuucacacagaccgccggaccuuggcaucucggcaaacuggagcuugauuuugaccugugcgaagggacgaccgugguuguggaugagcacugcggaaaccggggccccagccucagaacaaccacagucaccggcaagaucauucacgaaugguguugccgguccuguacgcugccuccccugcgcuucagaggggaggacggaugcugguauggcauggagauccggccggugaaagaaaaggaggaaaaucuuguuaagagcauggugucugcgggguccggagaggucgacagcuuuucccucggccugcuguguauuucuaucaugauugaagaggugaugagaagccgcuggucccggaaaaugcucaugacagggacccuggcuguuuuccuucugcucaucaugggacagcugacauggaacgaucugauuagacuuugcaucauggugggcgccaaugccucugaccgcaugggcauggggaccaccuaccuggcucucauggccacauuuaagaugagaccuauguucgcggucggacugcucuuucggcgccugacgagcagagaggugcuucugcucaccaucggccugucccugguggcuucugucgaacuucccaacagccuggaggaacucggggauggacuggccaugggcauuaugauccucaaacugcuuacagacuuccaaucccaucagcugugggccacccuccugagccugacauuuauuaagaccacguucucucuucacuaugcuuggaaaacaauggccaugguucuguccaucgugagccucuuuccccugugucucucuaccaccucccagaagacaaccuggcugccugugcuucuggggagccugggaugcaagccgcucacaauguuccugauugcugagaauaaaaucuggggccggcgcucuuggccccuuaacgaaggcaucauggccgucgggauuguguccauccugcucagcucccugcucaagaacgauguuccucuggcgggaccccuuauugccggcgggaugcugaucgcuuguuacgugauuagcggaucuagcgccgaccugucccucgagaaagcugccgaggucucuugggaagaggaagccgagcauagcggcgcuucccacaauauccugguggaaguucaggaugacgggacgaugaagaucaaagaugaggagagagacgauacccuuacaauucugcucaaggcgacccugcucgccgugucuggagucuauccucugagcauccccgcuacacuuuuugugugguacuucuggcagaagaagaagcagcgguccggcguccugugggacaccccuucucccccggaaguggagcgcgccguucuggaugacggcauuuauagaaucaugcagcgggggcuccugggacgcagccaggugggcgucgggguguuccaagaaaacguuuuucauacgauguggcacgugaccagaggagccguccuuauguaccagggcaaacggcuggagccuuccugggcuagcgugaagaaagaccucauuucuuacgggggaggcuggagacugcagggcuccuggaauacaggggaggaagugcagguuaucgccgucgagcccggaaagaacccuaaaaaugugcaaaccgcgcccggcacauucaagaccccggaaggggaggugggagcuauugcccucgauuuuaagccuggcacaagcgggucucccaucgucaaccgcgaaggaaaaaucgugggccuguauggcaaugggguugugacgaccuccggaacauacgucagcgccauugcucaggccaaggcgucccaggagggcccucuucccgagaucgaagacgagguguuccggaaaagaaaccugaccauuauggaucugcaccccgggucuggaaagacccgccgguaucucccugcuaucguuagagaagccauuaaacgcaagcugcggacacuuauccuggccccgacgagaguggucgcuagcgagauggccgaagcucucaagggcaugcccauccgcuaccaaaccacagccgugaaauccgagcauaccgggaaggagauuguugaccugaugugccacgcgacauuuaccaugcggcugcucagcccugugagaguccccaauuauaacaugaucauuauggaugaagcccauuucacggacccuucuuccaucgcugcccggggcuacauuagcacacgcgugggaaugggcgaggcugccgccaucuuuaugaccgcuacacccccugggucuguggaagcguucccgcagagcaaugccgucauccaggaugaggaaagagacauucccgagcgguccuggaacucuggauaugaguggaucacagauuuuccuggcaaaaccguuugguucgugcccagcauuaaguccgggaaugacaucgcuaacugucuucgcaaaaauggaaagagagugauucagcugucucggaagacauuugauaccgaauaccagaaaacgaagaacaacgacugggacuacgucgugacaaccgauaucagcgagaugggcgccaauuucagagccgaccgcguuauugauccucggagaugccugaaacccgugauccucaaggacgggccggaacgcgucauccuggcuggcccuaugcccgugacaguugccuccgcggcucagcggagaggacgcauuggccggaaccacaauaaagagggggaucaguauaucuacaugggacagccccuuaacaaugacgaggaucaugcccacuggaccgaagccaagaugcugcucgacaacauuaauacgccugagggcaucauucccgcucuguucgaaccugagagagaaaagagcgccgcgaucgauggggaguaucgccugagaggagaggcccggaaaaccuuuguggaacucaugcgcagaggcgaccuuccggucuggcugucuuacaagguggcuuccgagggguuccaauauagcgaucggcgcuggugcuuugacggcgaaagaaacaaucagguccuggaggaaaacauggauguggagaucuggacaaaagagggagaacggaagaaacucagaccccgcuggcuggacgcccggaccuacuccgacccucuugcucugagagaguucaaggaauuugccgcuggccgccggucuguuagcggggaucucauucuggagaucggaaaacugccccagcaccucacacagagagcccaaaaugcgcuugacaaccuggugaugcugcauaauuccgaacagggcgggcgggccuaucgccacgcuauggaggagcucccugauaccauugaaacacugaugcuucuggcccucaucgcugugcugaccggaggcgucacgcuguucuuucucucuggcagagggcuuggaaagacaagcauuggccugcuguguguuauggccuccagcgugcuccuguggauggccucuguggagccccauuggaucgcugcguccaucauucuugaguucuuucugaugguccuccugaucccggagccugaccggcagcgcacaccccaagauaaccaacuggccuacgugguuauugggcuccuuuucaugauccugaccguggcugccaaugagaugggacugcucgaaaccaccaagaaagaccugggcauugggcacgucgccgugggaaaccaccaucacgcugccaugcuugaugucgaccugcauccugcgagcgccuggacacucuacgcuguggccacgaccaucauuacacccaugaugagacacaccaucgagaacacaaccgcuaauaucucucugacggccauugcgaaccaggccgcuauccugaugggccucgauaagggcuggccuauuuccaaaauggacaucgggguuccccuucuggcccugggaugcuauagccaggugaauccgcucacccugacagcugccguccuuaugcugguggcucauuacgccauuaucggcccugggcuccaagcgaaggccacccgggaagcucagaaacgcacagccgcuggaaucaugaagaaccccaccguugauggcauuguggccaucgaccuggaucccgucguguaugacgccaaguuugagaaacagcuggggcagauuaugcuccuuauccuguguacgucucaaauucugcucaugagaacaaccugggcgcugugcgaaagcaucacacuugcuaccggaccucugaccacacucugggagggcuccccgggcaaguucuggaauacgaccaucgccgugucuauggcuaacauuuuucgggggagcuaccuggccggagccggccuggcuuucucccucaugaaaagccuugggggaggccgcagagggacaggagcccagggcgagacccugggcgaaaaguggaaacggcagcugaaucagcucuccaagucugaguucaacacauauaagagaagcgggaucauggaaguugaccgcuccgaggcgaaagaaggacugaagcggggcgagaccacgaaacacgccgucucuagagggacagcuaaacuucgcugguuuguggagcggaaucuggugaaacccgaaggaaaggucauugaucucggcugugggagaggaggcuggagcuacuauugcgccggccugaagaaaguuaccgaggugaagggguacaccaaaggaggcccugggcacgaagaacccaucccuauggcuacauacggauggaaccuggugaagcuccauuccggcaaagacgucuucuuuauucccccugaaaagugugauacccuucugugcgacaucggggagucuagcccgaaucccacaauugaggaaggacgcacgcugcgggugcucaaaaugguugagccuuggcugagaggcaaccaauucuguaucaagauccuuaaucccuauaugccuuccguggucgaaacccuggagcagaugcagcgcaagcacggcgggaugcucgugcggaacccccugagcagaaauucuacacaugagauguacuggguuuccugcggaaccggcaacauugugagcgccgucaauaugacaucucgcaugcugcucaaccgguuuaccauggcgcacagaaaaccgacguaugaacgcgauguggaccugggggccggaaccagacacguggcugucgagccugaaguugccaaccuugauaucauuggccagcggaucgagaauauuaagcaugaacacaaauccacauggcauuacgacgaggauaaccccuauaagaccugggcuuaccacgggagcuaugaggugaaacccucuggauccgccagcuccauggugaauggcgucgugaagcugcucacaaagccuugggacguuauccccauggugacccaaaucgcuaugacagauaccacgccuuucggccagcagcgcgucuuuaaagaaaagguggacacaagaaccccgaaagccaagcgggggaccgcgcaaauuauggagguuacagccaaauggcuguggggauuccuuagcagaaacaagaagccccggaucuguacgcgcgaagaguuuaccagaaaagugcggucuaaugcugccauuggcgcugucuucguggacgaaaaccaguggaauagcgccaaggaggccguugaggaugaacgcuuuugggaccuggugcauagagagcgggaacuccacaaacaggggaagugcgcgacaugcgucuacaacaugaugggaaaacgcgagaagaagcugggcgaguucgggaaagcuaagggcuccagagccaucugguacauguggcugggagcccgguuucucgaguucgaggcucugggcuucaugaaugaagaucacugguuuucucgcgagaacagccuuuccgggguggaaggagagggccugcauaaacucggguauauucugagagacaucucuaagaucccuggaggcaauauguacgccgaugacaccgcugggugggauacacggauuaccgaggacgaucuucagaacgaagcccgcaucacagacauuauggagcccgaacacgcgcugcucgccaaaagcaucuucaagcugaccuaucaaaauaaagucgugagaguucagcggccugcuaagaacggcacggugauggaugucauuucccgcagagaccagcggggaucuggccagguggggaccuacggacugaauacauuuaccaacauggaggcccaacucaucagacagauggaaagcgagggcaucuucucccccagcgagcuggaaacaccgaaccuugcugagcgcgugcuggauuggcucgaaaaguaugggguugagcggcugaaaagaauggccauuucuggagacgacuguguggucaagccuaucgaugaccgcuuugcgaccgcccuuacggcucugaaugauaugggcaaagugcggaaggacauuccccagugggaaccuuccaaaggguggaacgauuggcagcaaguucccuucugcagccaucacuuucaccagcucaucaugaaggacggcagagagauuguggucccuugucgcaaucaggaugagcuggugggacgggccagagucucucagggcgcuggguggucccugcgcgaaacagccugccucggaaagagcuacgcucaaauguggcagcugauguauuuccaucggagagaccuucgccuggccgcgaacgccaucuguuccgcugugcccguugauuggauuccgaccucucggacaaccuggagcauccacgcccaucaccaguggaugacgaccgaggacaugcucuccguguggaauagagucuggaucgaagagaacccuuggauggaagauaaaacacauauuagcucuuggggcgacgugcccuaccuggggaagcgggaggaccaauggugcggaucccuuaucggccugaccgccagagcuacaugggccaccaauauucagguugcgaucaaccaggugcgccggcucauugggaaugagaacuaccuggauuauaugacaagcaugaaaagauuuaagaaugaaucugaccccgagggcgcucugugguga

SEQ ID NO: 18582 - RNA, 9879 nt, Artificial Sequence
  derived and/or modified CDS sequence (opt5) from DENV-1__HM181949__SS-prME
agcgugaccaugcugcucaugcugaugcccaccgcccuugcuuuccaccugacgaccagaggaggggagccucauaugaucguguccaagcaggaacggggaaaaucucuccuguuuaagaccagcgccggaguuaacaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacaggacacggcaccacagcuaccaucacgccccaggccccuaccacagaaauucagcucaccgacuacggcgcccugacacuggauuguucuccccggaccgggcucgacuucaacgagaugguucugcuuacgaugaaggaaaaauccuggcuggugcauaagcagugguuucucgaucugccucuucccuggacaagcggagcuuccaccucucaagagacauggaaucgccaggaccugcucgucaccuucaaaaccgcgcacgccaagaagcaggagguggucgugcugggcagccaagaaggggcuaugcacacagcccugacgggagccaccgagauccagacauccggcaccacaaccauuuuugcugggcaucucaaaugcagacugaagauggauaaacuuacgcugaagggcaugagcuauguuauguguacaggaucuuucaaacucgaaaaggagguggccgaaacccagcacggcaccguccuggugcagaucaaguacgaggggacagacgcgccgugcaaaaucccuuucuccacccaagaugagaagggaguuacacagaacggccggcugauuacggcuaaucccaucgugaccgacaaagaaaagccugucaacauugaggccgaaccgcccuuuggggagagcuauaucgugauuggagccggcgagaaagcucuuaagcucucuugguucaagaaagggagcuccaucggcaagauguuugaagccacagcuagaggagcccgccggauggcgauccugggcgauaccgccugggacuucgggucuauuggaggcguguuuacaagcguugggaaacugguccaucagaucuucggaaccgcuuacggcgugcucuuuuccggggugagcuggacgaugaagauuggcaucggaguccugcuuaccuggcugggccucaauucuagauccacaagccugucuaugaccuguauugccguggggcugguuacacuuuaccucggagugaugguccaggcugauuccggcugcgugaucaacuggaaagggcgcgagcugaaguguggaagcggcauuuucguuaccaaugaagugcacacauggaccgagcaauauaaguuucaggccgacuccccuaaacggcugucugcggccaucgggaaggcuugggaagagggcgucugcggaaucagaagcgccacgcgccucgagaacauuauguggaaacagaucuccaacgaacugaaucauauucuucuggagaacgacaugaaguucacagugguugugggcgaugucgcugggauccucgcccagggcaagaagaugauucggccgcaacccauggaauacaaauauucuuggaaaagcuggggcaaggccaaaaucaucggggcugacgugcagaauaccaccuuuauuaucgauggaccuaacacacccgaguguccugacgaucagagagcguggaauauuugggaaguggaggacuacggcuucggcaucuuuaccacgaacauuuggcugaagcugcgcgauuccuauacacaggucugcgaccaccggcuuaugagcgccgcuaucaaagauucuaaggccguucacgccgacaugggguacuggaucgaguccgaaaagaaugagaccuggaagcucgcuagagccagcuucauugaagugaagacauguaucuggcccaaaucucauacccugugguccaacggagugcuggagagcgaaaugauuaucccgaagauuuauggcgggccuaucucucaacacaauuaccgccccggauacuucacacagaccgcgggcccuuggcaucucgggaaacuggagcuugauuuugaccugugcgagggaacgaccgucgugguugaugaacacugcggcaaccggggccccagccucagaacaaccacagugaccgggaagaucauucacgagugguguugccgguccuguacgcugccuccccugcgcuucagaggagaagacggcugcugguaugggauggagauccggccggucaaagagaaggaagagaaucuugucaagagcaugguuucugcuggauccggcgaaguggacagcuuuucccucgggcugcuguguauuucuaucaugauugaggaagucaugagaagccgcuggucccggaaaaugcucaugacaggaacccuggccguguuccuucugcucaucaugggccagcugacauggaacgaucugauuagacuuugcaucaugguuggcgccaaugcuucugaccgcauggggaugggaaccaccuaccuggcccucauggcgacauuuaagaugagaccuauguucgcugugggccugcucuuucggcgccugacgagcagagagguccuucugcucaccaucgggcugucccugguggccucuguggagcuucccaacagccuggaagaacucggagauggccuggccauggggauuaugauccucaaacugcuuacagacuuccaaucccaucagcugugggcuacccuccugagccugacauuuauuaagaccacguucucucuucacuaugccuggaaaacaauggcuaugguccuguccaucguuagccucuuuccccugugucucucuaccaccucccagaagacaaccuggcugccugugcuucugggaagccugggcugcaagccgcucacaauguuccugauugccgaaaauaaaaucuggggccggcgcucuuggccccuuaacgaggggaucauggcggugggaauugucuccauccugcucagcucccugcucaagaacgaugugccucuggccggcccccuuauugcugggggaaugcugaucgccuguuacguuauuagcggcucuagcgcugaccugucccucgaaaaagccgccgaggugucuugggaggaagaggcugaacauagcggggcgucccacaauauccuggucgaggugcaggaugacggaacgaugaagaucaaagaugaagagagagacgauacccuuacaauucugcucaaggccacccugcucgcuguuucuggcguguauccucugagcauccccgccacacuuuuugucugguacuucuggcagaaaaagaagcagcgguccggcgugcugugggacaccccuucucccccggaggucgaacgcgccgugcuggaugacgggauuuauagaaucaugcagcggggacuccugggccgcagccagguuggggugggagucuuccaagagaacguguuucauacgauguggcacguuaccagaggcgcugugcuuauguaccaggggaaacggcuggaaccuuccugggccagcgucaagaaagaccucauuucuuacggaggcggcuggagacugcagggguccuggaauacaggagaggaggugcaagugaucgcgguugaacccggcaagaacccuaaaaauguccaaaccgcucccgggacauucaagaccccggagggagaagugggcgccauugcccucgauuuuaagccugggacaagcggaucucccaucgugaaccgcgagggcaaaaucgucggccuguaugggaauggagugguuacgaccuccggcacauacgugagcgcuauugcccaggcgaaggcuucccaggaagggccucuucccgagaucgaggacgaagucuuccggaaaagaaaccugaccauuauggaucugcaccccggaucuggcaagacccgccgguaucucccugccaucgugagagaggccauuaaacgcaagcugcggacacuuauccuggcuccgacgagaguuguggccagcgaaauggcugaggcccucaaggggaugcccauccgcuaccaaaccacagcggucaaauccgaacauaccggcaaggagauuguggaccugaugugccacgccacauuuaccaugcggcugcucagcccuguuagagugcccaauuauaacaugaucauuauggaugaggcucauuucacggacccuucuuccaucgccgcucggggauacauuagcacacgcgucggcaugggggaagccgccgcuaucuuuaugaccgcgacacccccuggaucuguggaggccuucccgcagagcaaugcugugauccaggaugaagagagagacauucccgaacgguccuggaacucuggcuaugaguggaucacagauuuuccugggaaaaccgucugguucguucccagcauuaaguccggaaaugacaucgccaacugucuucgcaaaaauggcaagagagugauucagcugucucggaagacauuugauaccgaguaccagaaaacgaagaacaacgacugggacuacguggucacaaccgauaucagcgaaaugggggccaauuucagagcugaccgcgugauugauccucggagaugccugaaacccguuauccucaaggacggcccggagcgcgugauccuggccggaccuaugcccgucacaguggcguccgcugcccagcggagaggccgcauugggcggaaccacaauaaagaaggagaucaguauaucuacaugggccagccccuuaacaaugacgaggaucaugcccacuggaccgaggcuaagaugcugcucgacaacauuaauacgccugaagggaucauucccgcccuguucgagccugaaagagaaaagagcgcggccaucgauggagaauaucgccugagaggcgaggcucggaaaaccuuuguugagcucaugcgcagaggggaccuuccgguguggcugucuuacaaggucgccuccgaaggcuuccaauauagcgaucggcgcuggugcuuugacggagagagaaacaaucaggugcuggaagagaacauggaugucgaaaucuggacaaaagagggcgagcggaagaaacucagaccccgcuggcuggacgcucggaccuacuccgacccucuugcccugagagaguucaaggaguuugcugccgggcgccggucugugagcggagaucucauucuggaaaucggcaaacugccccagcaccucacacagagagcgcaaaaugcccuugacaaccugguuaugcugcauaauuccgagcaagggggacgggcuuaucgccacgccauggaggaacucccugauaccauugagacacugaugcuucuggcucucaucgccgugcugaccggcggcgugacgcuguucuuucucucugggagaggacuuggcaagacaagcauugggcugcugugugucauggccuccagcguucuccuguggauggcuucuguggaaccccauuggaucgcggccuccaucauucuugaguucuuucugauggugcuccugaucccggaaccugaccggcagcgcacaccccaggauaaccaacuggcuuacgucgugauuggacuccuuuucaugauccugaccguugccgccaaugagaugggccugcucgagacaaccaagaaagaccuggggauuggacacguggcugucggcaaccaccaucacgccgcgaugcuugauguggaccugcauccugccagcgcuuggacacucuacgccgucgcuacgaccaucauuacacccaugaugagacacaccaucgaaaacacaaccgccaauaucucucugacggcgauugccaaccaggcugccauccugaugggccucgauaagggguggccuauuuccaaaauggacaucggagugccccuucuggcucugggcugcuauagccagguuaauccgcucacccugacagccgcugugcuuaugcuggucgcccauuacgcgauuaucgggccuggacuccaagccaaggcuacccgggaggcccagaaacgcacagcugccggcaucaugaagaaccccaccguggaugggauuguugccaucgaccuggaucccguggucuaugacgcgaaguuugaaaaacagcugggacagauuaugcuccuuauccuguguacgucucaaauucugcucaugagaacaaccugggcucugugcgagagcaucacacuugccaccggcccucugaccacacucugggaaggcuccccggggaaguucuggaauacgaccaucgcugugucuauggccaacauuuuucggggaagcuaccuggccggcgcugggcuggccuucucccucaugaaaagccuuggacgcggcagacgggggacaggagcgcagggcgagacccugggcgagaaguggaaaagacagcugaaucagcucuccaagucugaguucaacacauauaagcgcagcgggaucauggagguggaccgguccgaagccaaagagggacugaagagaggcgaaaccacgaaacacgcuguuucucgcgggacagccaaacuucggugguuugucgagagaaaucuggugaaacccgagggaaaggugauugaucucggcugugggcgcggaggcuggagcuacuauugcgcuggccugaagaaagucaccgaaguuaagggguacaccaaaggaggcccugggcacgaggaacccaucccuauggccacauacggauggaaccuggugaagcuccauuccggcaaagacguguucuuuauucccccugagaagugugauacccuucugugcgacaucggggaaucuagcccgaaucccacaauugaggagggacggacgcugagaguccucaaaaugguggaaccuuggcugcgcggcaaccaauucuguaucaagauccuuaaucccuauaugccuuccguuguggagacccuggaacagaugcagcggaagcacggcgggaugcucgucagaaacccccugagccgcaauucuacacaugagauguacuggguguccugcggaaccggcaacauuguuagcgcggugaauaugacaucucggaugcugcucaacagauuuaccauggcccaccgcaaaccgacguaugagagagaugucgaccugggggcuggaacccggcacguggccguggaaccugaggucgcuaaccuugauaucauuggccagcgcaucgaaaauauuaagcaugagcacaaauccacauggcauuacgacgaagauaaccccuauaagaccugggccuaccacgggagcuaugagguuaaacccucuggauccgcuagcuccauggugaauggcguggucaagcugcucacaaagccuugggacgugauccccaugguuacccaaaucgccaugacagauaccacgccuuucggccagcagagaguguuuaaagagaaggucgacacacggaccccgaaagcgaagagagggaccgcccaaauuauggaagugacagcuaaauggcuguggggauuccuuagccggaacaagaagccccgcaucuguacgagagaggaauuuacccggaaaguucgcucuaaugccgcuauuggcgccguguucgucgacgagaaccaguggaauagcgccaaggaagcgguggaggaugagagauuuugggaccugguucaucgggaacgcgagcuccacaaacaggggaagugcgcuacaugcguguacaacaugaugggaaaaagagaaaagaagcugggcgaguucgggaaagccaagggcucccgggccaucugguacauguggcugggagcucgcuuucucgaguucgaggcccugggcuucaugaaugaggaucacugguuuucuagagaaaacagccuuuccggggucgagggagaaggccugcauaaacucggguauauucugcgggacaucucuaagaucccuggaggcaauauguacgcugaugacaccgccgggugggauacacgcauuaccgaggacgaucuucagaacgaggcgagaaucacagacauuauggaacccgagcacgcccugcucgcuaaaagcaucuucaagcugaccuaucaaaauaaagugguccgggugcagcgcccugccaagaacggcacgguuauggaugugauuuccagacgggaccagagaggaucuggccaggucgggaccuacggacugaauacauuuaccaacauggaagcucaacucauccgccagauggagagcgaaggcaucuucucccccagcgagcuggagacaccgaaccuugccgaacgggugcuggauuggcucgagaaguaugggguggaaagacugaaacgcauggcgauuucuggagacgacuguguugugaagccuaucgaugaccgguuugccaccgcucuuacggcccugaaugauaugggcaaagucagaaaggacauuccccagugggagccuuccaaaggguggaacgauuggcagcaagugcccuucugcagccaucacuuucaccagcucaucaugaaggacggccgcgaaauuguugugccuugucggaaucaggaugagcuggucggcagagcucgcgugucucagggcgccggguggucccugcgggagacagcuugccucggaaagagcuacgcccaaauguggcagcugauguauuuccauagacgcgaccuucggcuggcggccaacgcuaucuguuccgccguccccguggauuggauuccgaccucuagaacaaccuggagcauccacgcccaucaccaguggaugacgaccgaagacaugcucuccguuuggaaucggguguggaucgaggaaaacccuuggauggaggauaaaacacauauuagcucuuggggcgacguccccuaccuggggaagagagaagaccaauggugcggaucccuuaucggccugaccgcucgcgccacaugggcgaccaauauucagguggcuaucaaccagguucggagacucauugggaaugagaacuaccuggauuauaugacaagcaugaaacgcuuuaagaaugagucugaccccgaaggcgcccugugguga

SEQ ID NO: 18583 - RNA, 9879 nt, Artificial Sequence
  derived and/or modified CDS sequence (opt5) from DENV-1__HM181950__SS-prME
agcgugaccaugcugcucaugcugaugcccacagcccuugcuuuccaccugacgaccagaggcggggaaccucauaugaucguguccaagcaggaacggggaaaaucucuccuguuuaagaccagcgccggcguuaacaugugcacccuuaucgccauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucggggcugccuacggagugcucuuuuccggcgugagcuggaccaugaagauugggaucggcguccugcuuacguggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacagaacaauauaaguuucaggcggacuccccuaaacggcugucugccgcuaucggcaaggccugggaggagggggucugcggcaucagaagcgcuacccgccucgaaaacauuauguggaaacagaucuccaacgagcugaaucauauucuucuggaaaacgacaugaaguucacggugguugugggagaugucgccggcauccucgcccaggggaaaaagaugauucggccgcaacccauggaguacaaauauucuuggaaaagcuggggaaaggcuaagaucaucggcgcggacgugcagaauacaaccuuuauuaucgaugggccuaacacccccgaauguccugacgaucagagagccuggaauauuugggagguggaggacuacggauucggcaucuuuacaaccaacauuuggcugaagcugcgcgauuccuauacgcaggucugcgaccaccggcuuaugagcgcugccaucaaagauucuaaggccguucacgcugacaugggcuacuggaucgaauccgagaaaaaugaaacauggaagcucgccagagcgagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacagcuggaccuuggcaucucggcaaacuggagcuugauuuugaccugugcgaagggaccacggucgugguugaugagcacugcggaaaccggggccccagccucagaaccacaaccgugacaggcaagaucauucacgaaugguguugccgguccuguacccugccuccccugcgcuucagaggggaggacggaugcugguauggcauggagauccggccggucaaagaaaaggaggaaaaucuugucaagagcaugguuucugccggguccggagagguggacagcuuuucccucggccugcuguguauuucuaucaugauugaagaggucaugagaagccgcuggucccggaaaaugcucaugacggggacacuggccguguuccuucugcucaucaugggacagcugaccuggaacgaucugauuagacuuugcaucaugguuggcgcuaaugccucugaccgcaugggcauggggacaaccuaccuggcgcucauggcuaccuuuaagaugagaccuauguucgccgugggacugcucuuucggcgccugacaagcagagagguccuucugcucacgaucggccugucccugguggccucuguggaacuucccaacagccuggaggaacucggggauggacuggcuaugggcauuaugauccucaaacugcuuaccgacuuccaaucccaucagcugugggccacacuccugagccugaccuuuauuaagacaaccuucucucuucacuaugcuuggaaaacgauggccaugguccuguccaucguuagccucuuuccccugugucucucuacaaccucccagaagaccacauggcugccugugcuucuggggagccugggaugcaagccgcucaccauguuccugauugcggagaauaaaaucuggggccggcgcucuuggccccuuaacgaaggcaucauggccguggggauugucuccauccugcucagcucccugcucaagaacgaugugccucuggcuggaccccuuauugccggcgggaugcugaucgcuuguuacguuauuagcggaucuagcgccgaccugucccucgagaaagccgcugaggugucuugggaagaggaagcggagcauagcggcgccucccacaauauccuggucgaagugcaggaugacgggacaaugaagaucaaagaugaggagagagacgauacgcuuaccauucugcucaaggcuacacugcucgccguuucuggaguguauccucugagcauccccgccacccuuuuugucugguacuucuggcagaagaagaagcagcgguccggcgugcugugggacacaccuucucccccggaagucgagcgcgcugugcuggaugacggcauuuauagaaucaugcagcgggggcuccugggacgcagccagguuggcgugggggucuuccaagaaaacguguuucauaccauguggcacguuacgagaggagccgugcuuauguaccagggcaaacggcuggagccuuccugggcgagcgucaagaaagaccucauuucuuacgggggaggcuggagacugcagggcuccuggaauaccggggaggaagugcaagugaucgcuguugagcccggaaagaacccuaaaaauguccaaacagcccccggcaccuucaagacaccggaaggggaggugggagccauugcucucgauuuuaagccuggcaccagcgggucucccaucgugaaccgcgaaggaaaaaucgucggccuguauggcaauggggugguuacaacguccggaaccuacgugagcgccauugcgcaggcuaaggccucccaggagggcccucuucccgagaucgaagacgaggucuuccggaaaagaaaccugacaauuauggaucugcaccccgggucuggaaagacccgccgguaucucccugccaucgugagagaagcuauuaaacgcaagcugcggacccuuauccuggccccgacaagaguuguggcuagcgagauggccgaagcgcucaagggcaugcccauccgcuaccaaacgaccgccgucaaauccgagcauacagggaaggagauuguggaccugaugugccacgcuaccuuuacaaugcggcugcucagcccuguuagagugcccaauuauaacaugaucauuauggaugaagcccauuucaccgacccuucuuccaucgcugcccggggcuacauuagcacgcgcgucggaaugggcgaggccgcugcgaucuuuaugacagccacacccccugggucuguggaggcuuucccgcagagcaaugccgugauccaggaugaggaaagagacauucccgagcgguccuggaacucuggauaugaguggaucaccgauuuuccuggcaaaacagucugguucguucccagcauuaaguccgggaaugacaucgccaacugucuucgcaaaaauggaaagagagugauucagcugucucggaagaccuuugauacagaauaccagaaaaccaagaacaacgacugggacuacguggucacgacagauaucagcgagaugggcgcuaauuucagagccgaccgcgugauugauccucggagaugccugaaacccguuauccucaaggacgggccggaacgcgugauccuggcgggcccuaugcccgucaccguggcuuccgccgcccagcggagaggacgcauuggccggaaccacaauaaagagggggaucaguauaucuacaugggacagccccuuaacaaugacgaggaucaugcucacuggacagaagccaagaugcugcucgacaacauuaauaccccugagggcaucauucccgcgcuguucgaaccugagagagaaaagagcgccgcuaucgauggggaguaucgccugagaggagaggcccggaaaacguuuguugaacucaugcgcagaggcgaccuuccgguguggcugucuuacaaggucgcuuccgagggguuccaauauagcgaucggcgcuggugcuuugacggcgaaagaaacaaucaggugcuggaggaaaacauggaugucgagaucuggaccaaagagggagaacggaagaaacucagaccccgcuggcuggacgcccggacauacuccgacccucuugcucugagagaguucaaggaauuugccgcgggccgccggucugugagcggggaucucauucuggagaucggaaaacugccccagcaccucacccagagagcccaaaaugcucuugacaaccugguuaugcugcauaauuccgaacagggcgggcgggccuaucgccacgcuauggaggagcucccugauacaauugaaacccugaugcuucuggcccucaucgccgugcugacaggaggcgugacccuguucuuucucucuggcagagggcuuggaaagacgagcauuggccugcugugugucauggcuuccagcguucuccuguggauggcgucuguggagccccauuggaucgccgcuuccaucauucuugaguucuuucugauggugcuccugaucccggagccugaccggcagcgcacaccccaggauaaccaacuggccuacgucgugauugggcuccuuuucaugauccugaccguugccgcuaaugagaugggacugcucgaaaccacaaagaaagaccugggcauugggcacguggccgucggaaaccaccaucacgcggccaugcuugauguggaccugcauccugcuagcgccuggacccucuacgcugucgccacaacgaucauuacccccaugaugagacacacaaucgagaacaccacagcgaauaucucucugaccgccauugcuaaccaggccgcuauccugaugggccucgauaagggcuggccuauuuccaaaauggacaucggggugccccuucuggcccugggaugcuauagccagguuaauccgcucacgcugaccgcugccgugcuuaugcuggucgcgcauuacgccauuaucggcccugggcuccaagcuaaggccacacgggaagcucagaaacgcaccgccgccggaaucaugaagaaccccacaguggauggcauuguugcgaucgaccuggaucccguggucuaugacgcuaaguuugagaaacagcuggggcagauuaugcuccuuauccuguguaccucucaaauucugcucaugagaacgacaugggcccugugcgaaagcaucacccuugcuacaggaccucugaccacccucugggagggcuccccgggcaaguucuggaauacaacgaucgccgugucuauggccaacauuuuucgggggagcuaccuggcuggagccggccuggcguucucccucaugaaaagccuugggggaggccgcagagggaccggagcccagggcgagacacugggcgaaaaguggaaacggcagcugaaucagcucuccaagucugaguucaacaccuauaagagaagcgggaucauggaaguggaccgcuccgaggcuaaagaaggacugaagcggggcgagacaaccaaacacgccguuucuagagggacggcuaaacuucgcugguuugucgagcggaaucuggugaaacccgaaggaaaggugauugaucucggcugugggagaggaggcuggagcuacuauugcgccggccugaagaaagucacagagguuaagggguacaccaaaggaggcccugggcacgaagaacccaucccuauggcgaccuacggauggaaccuggugaagcuccauuccggcaaagacguguucuuuauucccccugaaaagugugauacacuucugugcgacaucggggagucuagcccgaaucccaccauugaggaaggacgcacacugcggguccucaaaaugguggagccuuggcugagaggcaaccaauucuguaucaagauccuuaaucccuauaugccuuccguuguggaaacgcuggagcagaugcagcgcaagcacggcgggaugcucguccggaacccccugagcagaaauucuacccaugagauguacuggguguccugcggaacaggcaacauuguuagcgccgugaauaugaccucucgcaugcugcucaaccgguuuacaauggcucacagaaaaccgaccuaugaacgcgaugucgaccugggggccggaacgagacacguggcuguggagccugaagucgccaaccuugauaucauuggccagcggaucgagaauauuaagcaugaacacaaauccaccuggcauuacgacgaggauaaccccuauaagacaugggcuuaccacgggagcuaugagguuaaacccucuggauccgccagcuccauggugaauggcguggucaagcugcucaccaagccuugggacgugauccccaugguuacacaaaucgcgaugaccgauacaaccccuuucggccagcagcgcguguuuaaagaaaaggucgacacgagaacaccgaaagccaagcgggggaccgcucaaauuauggaggugaccgccaaauggcuguggggauuccuuagcagaaacaagaagccccggaucuguacacgcgaagaguuuacgagaaaaguucggucuaaugcugccauuggcgccguguucgucgacgaaaaccaguggaauagcgcgaaggaggcuguggaggaugaacgcuuuugggaccugguucauagagagcgggaacuccacaaacaggggaagugcgcgaccugcguguacaacaugaugggaaaacgcgagaagaagcugggcgaguucgggaaagccaagggcuccagagcuaucugguacauguggcugggagcccgguuucucgaguucgaggcucugggcuucaugaaugaagaucacugguuuucucgcgagaacagccuuuccggggucgaaggagagggccugcauaaacucggguauauucugagagacaucucuaagaucccuggaggcaauauguacgccgaugacacagcggggugggauacccggauuacagaggacgaucuucagaacgaagcccgcaucaccgacauuauggagcccgaacacgcucugcucgccaaaagcaucuucaagcugacauaucaaaauaaaguggucagagugcagcggccugcuaagaacggcaccguuauggaugugauuucccgcagagaccagcggggaucuggccaggucgggacguacagccugaauaccuuuacaaacauggaggcccaacucaucagacagauggaauccgagggaaucuucagccccucugagcuggaaaccccgaaccuugcggagcgcgugcuggauuggcucgaaaaguauggcguggagcggcugaaaagaauggccauuuccggggacgacuguguugugaagccuaucgaugaccgcuuugcuacagcccuuaccgcucugaaugauaugggaaaaguccggaaggacauuccccagugggaaccuagcaaaggcuggaacgauuggcagcaagugcccuucugcucucaucacuuucaccagcucaucaugaaggacgggagagagauuguugugccuugucgcaaucaggaugagcuggucggccgggccagagugucccagggagcuggcuggagccugcgcgaaacggccugccucgggaaguccuacgcgcaaauguggcagcugauguauuuccaucggagagaccuucgccuggccgcuaacgccaucuguucugccguccccguggauuggauuccgacaagccggaccacaugguccauccacgcucaucaccaguggaugaccacggaggacaugcucagcguuuggaauagaguguggaucgaagagaacccuuggauggaagauaaaacccauauuucuuccuggggagacguccccuaccugggcaagcgggaggaccaauggugcgggagccuuaucggacugacagccagagcgaccugggcuacaaauauucagguggccaucaaccagguucgccggcucauuggcaaugagaacuaccuggauuauaugaccucuaugaaaagauuuaagaaugaaagcgaccccgagggggcccugugguga

SEQ ID NO: 18584 - RNA, 9879 nt, Artificial Sequence
  derived and/or modified CDS sequence (opt5) from DENV-1__HM181952__SS-prME
agcgugaccaugcugcucaugcugaugcccaccgcccuugcuuuccaccugacgaccagaggcggggagccucauaugaucgucuccaagcaggaacggggaaagucucuccuguuuaagacgagcgccggcguuaacaugugcacccuuauugcgauggaccugggggagcucugugaagauacaaugaccuacaagugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggacuuuguugagggacugagcggcgccacauggguggaugucgugcucgaacacgggucuugugugacgaccauggcuaaggacaaacccacacuggauaucgagcugcucaagaccgaagucacaaacccugccguucugcgcaaacuuugcauugaggcgaagaucuccaauaccacgacagacagcagauguccgacccaaggagaagccacccugguggaggagcaggaugcuaacuucgugugccggcgcacauuugucgacagaggcuggggcaauggguguggacucuucggcaaagggucucugcuuaccugcgccaaguuuaagugcgugacaaaacuggaaggaaagauuguucaguacgagaaccucaaauauuccgugaucgucacggugcacaccggcgaucagcaucaaguugggaaugaaagcacagagcacggaaccacagcuaccaucacgccccaggccccuaccacagaaauucagcugaccgacuacggcgcccugacacucgacuguucuccccggaccggccuggauuucaacgagauggugcuucugacgaugaaggagaaauccuggcucguccauaagcagugguuucuggaccuuccucugcccuggacaagcggggcuuccaccucucaagaaacauggaaucgccaggaucuccuggugaccuucaaaaccgcgcacgccaagaagcaggaggucgugguucugggaagccaagaaggcgcuaugcacacagcccucacgggggccaccgagauccagacauccggaaccacaaccauuuuugcuggccaucugaaaugcagacuuaagauggacaaacugacgcucaaggggaugagcuaugugauguguacaggcucuuucaaacuggaaaaggaggucgccgagacccagcacggaaccgugcugguucagaucaaguacgaaggcacagaugcgccgugcaaaauuccuuucuccacccaagacgagaagggggugacacagaacggacggcuuaucacggcuaaucccaucgucaccgauaaagaaaagccugugaacauugaggccgagccgcccuuuggcgaaagcuauaucgugauuggggccggagagaaagcucucaagcugucuugguucaagaaaggcagcuccaucgggaagauguuugaagccacagcuagaggcgcccgccggauggcgauucugggagacaccgccugggauuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacucaauucuagauccacaagccugucuaugaccuguauugccguuggccuugugacacucuaccugggggucauggugcaggcugacuccggaugcguuaucaacuggaaaggccgcgagcugaagugugggagcggaauuuucgugaccaaugaaguccacacauggaccgagcaauauaaguuucaggccgauuccccuaaacggcucucugcggccaucggcaaggcuugggaggaaggggugugcggcauuagaagcgccacgcgccuggagaacaucauguggaaacagaucuccaacgaacuuaaucauauucugcucgagaacgacaugaaguucacaguuguggucggagacguggcuggcauccuggugcaggggaaaaagaugauucggccgcaacccauggaauacaaauauucuuggaaaagcuggggaaaggccaaaaucauuggcgccgauguccaaaauuccaccuuuaucaucgacgggccuaacacccccgaguguccugaugaccagagagcuuggaauauuugggagguugaagauuacggauucggcaucuuuacaaccaacauuuggcugaaacuucgcgacagcuauacacaggugugcgaucaccggcucaugucugcggccaucaaagacuccaaggcugugcacgccgauaugggcuacuggauugagagcgagaagaaugagacauggaagcuggccaaggcuucuuucaucgaagucaaaaccuguaucuggcccaagucccauacacuguggagcaacggggugcucgagucugagaugauuaucccgaaaauucacggaggcccuaucagccaacauaauuauagacccggguacuucacccagacagccggaccuuggcaccugggcaaacuugaacuggacuuugaucucugcgaggggaccacgguuguggucgacgaacacugcggaaaccgcggccccucccugcggaccacaaccgugacaggcaaaauuauccaugagugguguugcagaagcuguacccugccuccccuucgguuccgcggggaggauggaugcugguacggcauggaaaucagaccgguuaaggagaaggaagagaaucucgugaaaucuauggucuccgcggggagcggagaaguggacuccuuuucucugggccugcucuguauuagcaucaugauugaggagguuaugcgguccagauggucucgcaagaugcugaugacggggacacuugcuguguucuuucugcucaucaugggacagcugaccuggaacgaccugauucggcuuugcaucauggucggcgccaaugccagcgauagaaugggcauggggacaaccuaucuggcucucauggccaccuucaaaaugcgcccuauguuugcggugggacugcuguucagacggcugacaucccgcgaagugcuucugcucacgauuggccugucucuggucgcuagcguugagcuucccaacucccuggaagaacucggggacggacuggccaugggcaucaugauccucaagcugcuuaccgauuuucaaagcuaccagcugugggccacacuccugucucugaccuucauuaaaacaaccuuuucccuucacuaugcuuggaagacgauggccauggugcugagcaucgugucucucuucccccugugucucuccacaaccagccagaagaccacauggcugccuguccuucuggggucucugggaugcaaaccgcucaccauguuucugauugcugaaaauaagaucuggggcagaaaauccuggccccuuaacgagggcauuauggccguggggaucguuagcauccugcucuccagccugcucaagaacgacgugccucuggcgggaccccuuauugccggcgggaugcugaucgcuuguuacgucauuucuggaagcuccgccgaucugucucucgagaaagcugccgaagugagcugggaggaagaggccgaacauuccggcgcuucucacaauauccugguugaggugcaggacgaugggacaaugaagauuaaagacgaggaacgggaugacacgcuuaccauccugcucaaggcgacacugcucgccgucagcggaguguauccucuguccauccccgcuacccuuuucgucuggcauuucuggcaaaagaaaaagcagcgcucuggcgugcugugggauacaccuagcccucccgagguugaaagagccgugcuggacgauggcauuuaccggaucaugcagcgcgggcuccugggaagaucccaggucggcguggggguuuuucaagagaacguguuccacaccauguggcacgucacgcggggagccgugcuuauguaucagggcaaacgccuggagcccagcugggcuucugugaagaaagaccucauuuccuacgggggaggcuggagacugcagggcagcuggaauaccggggaagagguucaggucaucgccguggaacccggaaagaacccuaagaaugugcaaacagcgcccggcaccuuuaaaacaccggagggggaagucggagcuauugcccucgacuucaagccuggcaccucugggucccccaucgugaaccgggagggaaaaauuguuggccuguacggcaaugggguggucacaacgagcggaaccuauguguccgccaucgcucaggccaaggcgucucaggagggcccucuucccgaaaucgaggaugaaguuuuuagaaaacgcaaccugacaauuauggaccugcaucccgggagcggaaagacccggagauaccucccugcuaucgugcgcgaggccauuaagcggaaacugagaacccuuauccuggccccgacacgcgucguggcuuccgaaauggccgaggcucucaagggcaugcccauucgguaucaaacgaccgccguuaaaagcgagcacacagggaaggaaaucguggaucugaugugccaugcgaccuucacaaugagacugcucucuccuguccgcgugcccaauuacaacaugaucauuauggacgaggcccacuuuaccgauccuuccagcaucgcugcccggggcuauauuucuacgagagugggaaugggcgaagcugccgccaucuucaugacagcuacacccccugggagcauggaggcguuuccgcaguccaaugccgucauucaggacgaagaacgggauauccccgagcgcucuuggaacagcggauacgaauggaucaccgacuucccuggcaaaacaguuugguuugugcccuccauuaaggcugggaaugauaucgccaacugucuuagaaagaauggaaaacgggugauucagcugucucgcaagaccuucgacacagaguaucagaagaccaagaacaacgauugggacuacgucgugacgacagacaucagcgaaaugggcgccaauuucagagcugaucggguuauugacccuagacgcugccugaaacccgugauccucaaggaugggccggagcgggucauucuggccggcccuaugcccgugaccguugcguccgcugcccagagacgcggacggaucggcagaaaccauaauaaggagggggaccaguacaucuauaugggacagccccuuaacaaugaugaagaccacgcccacuggacagaggcuaaaaugcugcucgauaacauuaauaccccugaaggcaucauucccgcccuguuugagccugaacgcgaaaagagcgcggccaucgacggggaguaccggcugagaggagaagcucgcaaaacguucguggagcucaugagacggggcgaucuuccggucuggcugucuuauaagguggccuccgaaggguuucaauacagcgaccgcagauggugcuucgauggcgagcggaacaaucagguccuggaagagaacauggacguggagauuuggaccaaagaaggagagcgcaagaaacucagaccccgguggcuggaugcuagaacauauuccgacccucuugcccugcgcgaauuuaaggaguucgcugccggccggagaucuguuagcggggaccucauccuggaaaucggaaagcugccccagcaucucacccagcgcgcgcaaaaugcccuugauaaccuggugaugcugcacaauuccgagcagggcgggcgggcuuacagacaugccauggaggaacucccugacacaauugagacccugaugcuucuggcucucaucgccgugcugacaggaggcgucacccuguuuuuccucucuggcaaagggcuuggaaagacgagcauuggccugcuguguguuauggccuccagcgugcuccuguggauggcuucuguggaaccccacuggaucgcggccuccauuauccuugaguuuuuccugaugguccuccugaucccggagccugaucggcagcgcacaccccaggacaaccaacuggcuuaugugguuauugggcuccuuuuuaugauccugaccguggccgccaaugaaaugggacugcucgagaccaccaagaaggaucugggcauugggcacgucgcuguggaaaaccaucaccaugccgcgaugcuugacgucgaucugcacccugccagcgcuuggacccucuacgccguggcuacaacgaucauuacccccaugaugagacauacaaucgagaacaccacagccaauauuucucugaccgcgaucgccaaccaggcugccauccugaugggacucgacaaaggcuggccuauuuccaagauggauaucggcguuccccuucuggcucuggggugcuacagccaggugaauccgcucacgcugaccgccgcuguccuuaugcugguggcccacuaugcgauuguuggaccuggccuccaagccaaggcuacacgggaagcccagaaacgcaccgcugccgggaucaugaagaaccccacaauugacggaaucguggccaucgaucuggaccccgucguguacgaugcgaaauucgagaagcagcugggccagauuaugcuccuuauccuguguaccucucaaauucugcucaugagaacgacaugggcucugugcgagagcaucacccuugccacagggccucugaccacccucugggaaggauccccgggcaaauuuuggaauacaacgauugcugugucuauggccaacaucuuccggggcagcuaucuggccggggcuggacuggccuucucccucaugaaaagccuuggcgggggacgcagaggcaccggggcgcagggagagacacugggcgaaaaguggaaacggcagcugaaucagcucuccaagucugaguuuaacaccuacaaacgcagcggcaucauggaaguugacagauccgaggccaaggaggggcugaaacggggagaaacaaccaagcacgcugucucuagaggcacggccaaacuucgcugguucguggagcggaaucuggugaaacccgaagggaaggucauugaccucggauguggcagagggggauggagcuauuacugcgcuggccugaaaaagguuacagaggugaaaggcuauaccaaagggggaccuggccaugaggagcccaucccuauggccaccuacggguggaaccuggugaaacuccacuccggaaaggaugucuuuuucauucccccugagaagugugacacacuucugugcgauaucggcgaaucuagcccgaaucccaccauugaggaagggcgcacacugcgggugcucaaaaugguugagccuuggcugagaggaaaccaauuuuguaucaagauucuuaaucccuacaugccuuccguggucgagacgcuggaacagaugcagcgcaaacauggcggcaugcucgugcggaacccccugagcagaaauucuacccacgagauguauuggguuuccugcgggacaggaaacaucgugagcgcggucaauaugaccucucgcaugcugcucaaccgguucacaauggcccacagaaagccgaccuacgaacgcgacguggaucugggcgcugggacgcggcauguggccgucgagccugaaguugcuaaccuugacaucauuggacagagaaucgagaauauuaaacacgagcauaaguccaccuggcacuaugaugaagacaaccccuacaagacaugggccuaucauggcagcuacgaggugaaacccucuggguccgcuagcuccauggugaauggagucgugaagcugcucaccaaaccuugggauguuauccccauggugacacaaauugccaugaccgacacaaccccuuuuggccagcagcgcgucuucaaggaaaaaguggauacgagaacaccgaaggcgaagcggggcaccgcccaaaucauggagguuaccgcucgcuggcuguggggguuucuuagcagaaacaaaaagccccggaucuguacaagagaagaguucacgcggaaagugcgcucuaaugccgcuauuggagccgucuuuguggacgagaaccaguggaauagcgccaaggaagcgguugaggacgauagauucugggaccuggugcaccgggaacgcgagcuccacaaacagggcaagugcgcuaccugcgucuauaacaugauggggaagagagagaagaagcugggagaguuuggcaaagccaaggggucccgggccaucugguacauguggcugggcgcucgcuuccucgaguucgaagcccugggauuuaugaaugaggaucauugguucucuagagaaaacagccuuuccggcguggagggggagggacugcacaaacucggcuacauucugcgggacaucucuaagauuccugggggaaauauguaugcugaugacacagccggcugggauacccgcaucacagaagacgaucuucagaacgaggcgaaaaucaccgacauuauggaacccgagcaugcccugcucgcuaagagcaucuuuaagcugacauaccaaaauaaagucgugagaguucagcggccugccaagaacgggaccgugauggaugucauuucccgcagagaccagcggggcucuggacaggugggcacguaugggcugaauaccuucacaaacauggaagcucaacucauccgccagauggagagcgagggaauuuuucugcccaacgaacuugagaccccgaaucuggccgaaagagugcucgauuggcuggagaaauacggcguugaacggcuuaagagaauggcgaucuccggggacgacuguguggucaaaccuaucgaugaccgcuucgccacagcucugaccgcccucaacgauaugggaaaggugcggaaggacauuccccagugggagccuagcaaaggcuggaaugauuggcagcaaguucccuuuugcucucaccacuuccaucagcugaucaugaaggacgggagagagauuguggucccuugucgcaaccaggaugaacuggugggccgggcuagagucucccagggagccggcuggagccuccgcgagacggcuugccuggggaaaucuuaugcccaaauguggcagcuuauguacuuucaccggagagaccugcgccucgcggccaaugcuaucuguuccgccgugcccguugauugggugccgacaagccggaccacaugguccauucaugcccaccaucaguggaugaccacggaagacaugcugucugucuggaacagaguguggaucgaggaaaauccuuggauggaggauaagacccgcauuagcuccugggaggacguucccuaucuuggaaaacgggaagaccaauggugcggcagccugaucgggcucacagcuagagccaccugggcgacaaacauccagguggcuauuaaucagguccggagacugaucggaaacgagaauuacucugauuacaugaccuccaugaagcgcuucaagaacgaaagcgagcccgagggcgcccugugguga

SEQ ID NO: 18585 - RNA, 9879 nt, Artificial Sequence
  derived and/or modified CDS sequence (opt5) from DENV-1__HM181953__SS-prME
agcgugaccaugcugcucaugcugaugcccacagcccuugcuuuccaccugacgaccagaggcggggagccucauaugaucgucuccaagcaggaacggggaaaaucucuccuguuuaagaccagcgccggcguuaauaugugcacccuuaucgcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagaacaagacgcuaacuucgugugccggcgcacauuuguggauagaggcuggggcaauggguguggacucuucggcaaagggucucugauuaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauccagacauccggaaccacaaccauuuuugcuggccaucucaaaugcagacugaagauggauaaacuuacgcugaaggggaugagcuauguuauguguacaggcucuuucaaacucgagaaggaaguggccgagacccagcacggaaccguccuggugcagaucaaguacgagggcacagacgcgccgugcaaaaucccuuucuccacccaagaugaaaaggggguuacacagaacggacggcugauuacggcuaaucccaucgugaccgacaaagagaagccugucaacauugaagccgagccgcccuuuggcgagagcuauaucgugauuggggccggagaaaaagcucuuaagcucucuugguucaagaaaggcagcuccaucgggaagauguuugaggccacagcuagaggcgcccgccggauggcgauccugggagauaccgccugggacuucggcucuauugggggaguguuuacaagcguuggcaaacugguccaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaaguucacagugguugugggagaugucgcuggcauccucgugcaggggaaaaagaugauucggccgcaacccauggaguacaaauauucuuggaaaagcuggggaaaggccaagaucaucggcgccgacgugcagaauaccaccuuuauuaucgaugggccuaacacacccgaauguccugacgaucagagagcuuggaauauuugggaggucgaggacuacggauucggcaucuuuaccacgaacauuuggcugaagcugcgcgauuccuauacacagguuugcgaccaccggcuuaugagcgcggccaucaaagauucuaaggcugugcacgccgacaugggcuacuggaucgaauccgagaaaaaugaaaccuggaagcucgccagagcuagcuucauugaggugaagacauguaucuggcccaaaucucauacccugugguccaacgggguccuggaaagcgagaugauuaucccgaagauuuauggaggcccuaucucucaacacaauuaccgccccggguacuucacacagaccgccggaccuuggcaucucggcaaacuggagcuugauuuugaccugugcgaagggacgaccgugguuguggaugagcacugcggaaaccggggccccagccucagaacaaccacagucaccggcaagaucauucacgaaugguguugccgguccuguacgcugccuccccugcgcuucagaggggaggacggaugcugguauggcauggagauccggccggugaaagaaaaggaggaaaaucuuguuaagagcauggugucugcgggguccggagaggucgacagcuuuucccucggccugcuguguauuucuaucaugauugaagaggugaugagaagccgcuggucccggaaaaugcucaugacagggacccuggcuguuuuccuucugcucaucaugggacagcugacauggaacgaucugauuagacuuugcaucauggugggcgccaaugccucugaccgcaugggcauggggaccaccuaccuggcucucauggccacauuuaagaugagaccuauguucgcggucggacugcucuuucggcgccugacgagcagagaggugcuucugcucaccaucggccugucccugguggcuucugucgaacuucccaacagccuggaggaacucggggauggacuggccaugggcauuaugauccucaaacugcuuacagacuuccaaucccaucagcugugggccacccuccugagccugacauuuauuaagaccacguucucucuucacuaugcuuggaaaacaauggccaugguucuguccaucgugagccucuuuccccugugucucucuaccaccucccagaagacaaccuggcugccugugcuucuggggagccugggaugcaagccgcucacaauguuccugauugcugagaauaaaaucuggggccggcgcucuuggccccuuaacgaaggcaucauggccgucgggauuguguccauccugcucagcucccugcucaagaacgauguuccucuggcgggaccccuuauugccggcgggaugcugaucgcuuguuacgugauuagcggaucuagcgccgaccugucccucgagaaagcugccgaggucucuugggaagaggaagccgagcauagcggcgcuucccacaauauccugguggaaguucaggaugacgggacgaugaagaucaaagaugaggagagagacgauacccuuacaauucugcucaaggcgacccugcucgccgugucuggagucuauccucugagcauccccgcuacacuuuuugugugguacuucuggcagaagaagaagcagcgguccggcguccugugggacaccccuucucccccggaaguggagcgcgccguucuggaugacggcauuuauagaaucaugcagcgggggcuccugggacgcagccaggugggcgucgggguguuccaagaaaacguuuuucauacgauguggcacgugaccagaggagccguccuuauguaccagggcaaacggcuggagccuuccugggcuagcgugaagaaagaccucauuucuuacgggggaggcuggagacugcagggcuccuggaauacaggggaggaagugcagguuaucgccgucgagcccggaaagaacccuaaaaaugugcaaaccgcgcccggcacauucaagaccccggaaggggaggugggagcuauugcccucgauuuuaagccuggcacaagcgggucucccaucgucaaccgcgaaggaaaaaucgugggccuguauggcaaugggguugugacgaccuccggaacauacgucagcgccauugcucaggccaaggcgucccaggagggcccucuucccgagaucgaagacgagguguuccggaaaagaaaccugaccauuauggaucugcaccccgggucuggaaagacccgccgguaucucccugcuaucguuagagaagccauuaaacgcaagcugcggacacuuauccuggccccgacgagaguggucgcuagcgagauggccgaagcucucaagggcaugcccauccgcuaccaaaccacagccgugaaauccgagcauaccgggaaggagauuguugaccugaugugccacgcgacauuuaccaugcggcugcucagcccugugagaguccccaauuauaacaugaucauuauggaugaagcccauuucacggacccuucuuccaucgcugcccggggcuacauuagcacacgcgugggaaugggcgaggcugccgccaucuuuaugaccgcuacacccccugggucuguggaagcguucccgcagagcaaugccgucauccaggaugaggaaagagacauucccgagcgguccuggaacucuggauaugaguggaucacagauuuuccuggcaaaaccguuugguucgugcccagcauuaaguccgggaaugacaucgcuaacugucuucgcaaaaauggaaagagagugauucagcugucucggaagacauuugauaccgaauaccagaaaacgaagaacaacgacugggacuacgucgugacaaccgauaucagcgagaugggcgccaauuucagagccgaccgcguuauugauccucggagaugccugaaacccgugauccucaaggacgggccggaacgcgucauccuggcuggcccuaugcccgugacaguugccuccgcggcucagcggagaggacgcauuggccggaaccacaauaaagagggggaucaguauaucuacaugggacagccccuuaacaaugacgaggaucaugcccacuggaccgaagccaagaugcugcucgacaacauuaauacgccugagggcaucauucccgcucuguucgaaccugagagagaaaagagcgccgcgaucgauggggaguaucgccugagaggagaggcccggaaaaccuuuguggaacucaugcgcagaggcgaccuuccggucuggcugucuuacaagguggcuuccgagggguuccaauauagcgaucggcgcuggugcuuugacggcgaaagaaacaaucagguccuggaggaaaacauggauguggagaucuggacaaaagagggagaacggaagaaacucagaccccgcuggcuggacgcccggaccuacuccgacccucuugcucugagagaguucaaggaauuugccgcuggccgccggucuguuagcggggaucucauucuggagaucggaaaacugccccagcaccucacacagagagcccaaaaugcgcuugacaaccuggugaugcugcauaauuccgaacagggcgggcgggccuaucgccacgcuauggaggagcucccugauaccauugaaacacugaugcuucuggcccucaucgcugugcugaccggaggcgucacgcuguucuuucucucuggcagagggcuuggaaagacaagcauuggccugcuguguguuauggccuccagcgugcuccuguggauggccucuguggagccccauuggaucgcugcguccaucauucuugaguucuuucugaugguccuccugaucccggagccugaccggcagcgcacaccccaagauaaccaacuggccuacgugguuauugggcuccuuuucaugauccugaccguggcugccaaugagaugggacugcucgaaaccaccaagaaagaccugggcauugggcacgucgccgugggaaaccaccaucacgcugccaugcuugaugucgaccugcauccugcgagcgccuggacacucuacgcuguggccacgaccaucauuacacccaugaugagacacaccaucgagaacacaaccgcuaauaucucucugacggccauugcgaaccaggccgcuauccugaugggccucgauaagggcuggccuauuuccaaaauggacaucgggguuccccuucuggcccugggaugcuauagccaggugaauccgcucacccugacagcugccguccuuaugcugguggcucauuacgccauuaucggcccugggcuccaagcgaaggccacccgggaagcucagaaacgcacagccgcuggaaucaugaagaaccccaccguugauggcauuguggccaucgaccuggaucccgucguguaugacgccaaguuugagaaacagcuggggcagauuaugcuccuuauccuguguacgucucaaauucugcucaugagaacaaccugggcgcugugcgaaagcaucacacuugcuaccggaccucugaccacacucugggagggcuccccgggcaaguucuggaauacgaccaucgccgugucuauggcuaacauuuuucgggggagcuaccuggccggagccggccuggcuuucucccucaugaaaagccuugggggaggccgcagagggacaggagcccagggcgagacccugggcgaaaaguggaaacggcagcugaaucagcucuccaagcuggaguucaacacauauaagagaucugggaucauggaaguugaccgcagcgaggcgaaagaaggacuuaagcggggcgagaccacgaaacacgccgucuccagagggacagcuaagcugcgcugguuuguggagcggaaucucgugaaacccgaaggaaaggucauugaucugggcugugggagaggaggcuggucuuacuauugcgccggccugaagaaaguuaccgaggugaagggguacaccaaaggaggcccugggcacgaagaacccaucccuauggcuacauacggauggaaccucgugaaacuucauagcggcaaagacgucuucuuuauucccccugaaaagugugauacccugcugugcgacaucggggaguccucuccgaaucccacaauugaggaaggacgcacgcuccgggugcugaaaaugguugagccuuggcuuagaggcaaccaauucuguaucaagauccugaaucccuauaugccuagcguggucgaaacccucgagcagaugcagcgcaagcacggcgggaugcuggugcggaacccccuguccagaaauagcacacaugagauguacuggguuucuugcggaaccggcaacauuguguccgccgucaauaugacaagccgcaugcuccugaaccgguuuaccauggcgcacagaaaaccgacguaugaacgcgauguggaccuuggggccggaaccagacacguggcugucgagccugaaguugccaaccuggauaucauuggccagcggaucgagaauauuaagcaugaacacaaaucuacauggcauuacgacgaggauaaccccuauaagaccugggcuuaccacggguccuaugaggugaaacccagcggaucugccuccagcauggugaauggcgucgugaagcuccugacaaagccuugggacguuauccccauggugacccaaaucgcuaugacagauaccacgccuuucggccagcagcgcgucuuuaaagaaaagguggacacaagaaccccgaaagccaagcgggggaccgcgcaaauuauggagguuacagccaaauggcuuuggggauuccuguccagaaacaagaagccccggaucuguacgcgcgaagaguuuaccagaaaagugcggagcaaugcugccauuggcgcugucuucguggacgaaaaccaguggaacucugccaaggaggccguugaggaugaacgcuuuugggaccucgugcauagagagcgggaacugcacaaacaggggaagugcgcgacaugcgucuacaacaugaugggaaaacgcgagaagaagcugggcgaguucgggaaagcuaagggcagcagagccaucugguacauguggcucggagcccgguuucuggaguucgaggcucuuggcuucaugaaugaagaucacugguuuucccgcgagaacucucugagcgggguggaaggagagggccuccauaaacugggguauauucuuagagacaucuccaagaucccuggaggcaauauguacgccgaugacaccgcugggugggauacacggauuaccgaggacgaucugcagaacgaagcccgcaucacagacauuauggagcccgaacacgcgcuccuggccaaaucuaucuucaagcugaccuaucaaaauaaagucgugagaguucagcggccugcuaagaacggcacggugauggaugucauuagccgcagagaccagcggggauccggccagguggggaccuacggacucaauacauuuaccaacauggaggcccaacugaucagacagauggaaucugagggcaucuucagccccuccgagcuugaaacaccgaaccuggcugagcgcgugcucgauuggcuggaaaaguaugggguugagcggcuuaaaagaauggccauuagcggagacgacuguguggucaagccuaucgaugaccgcuuugcgaccgcccugacggcucucaaugauaugggcaaagugcggaaggacauuccccagugggaaccuucuaaaggguggaacgauuggcagcaaguucccuucugcucccaucacuuucaccagcugaucaugaaggacggcagagagauuguggucccuugucgcaaucaggaugagcuggugggacgggccagagucagccagggcgcuggguggucucuccgcgaaacagccugccugggaaaguccuacgcucaaauguggcagcuuauguauuuccaucggagagaccugcgccucgccgcgaacgccaucuguagcgcugugcccguugauuggauuccgaccucccggacaaccuggucuauccacgcccaucaccaguggaugacgaccgaggacaugcugagcguguggaauagagucuggaucgaagagaacccuuggauggaagauaaaacacauauuuccagcuggggcgacgugcccuaccuugggaagcgggaggaccaauggugcggaucucugaucggccucaccgccagagcuacaugggccaccaauauucagguugcgaucaaccaggugcgccggcugauugggaaugagaacuaccuggauuauaugacauccaugaaaagauuuaagaaugaaagcgaccccgagggcgcucucugguga

SEQ ID NO: 18586 - RNA, 9879 nt, Artificial Sequence
  derived and/or modified CDS sequence (opt5) from DENV-1__KF921933__SS-prME
agcgugaccaugcugcucaugcugaugcccacagcccuugcuuuccaccugacgacccggggaggggaaccucauaugaucguguccaagcaggaacggggaaagucucuccuguuuaagacaagcgccggcguuaacaugugcacccuuaucgcgauggaccugggggagcucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcaaauguccgacccaaggagaggccacccugguugaagaacaggacgcuaacuucgugugcagacggacauuuguggaucgcggcuggggcaauggguguggacucuucggcaaggggucucugauuaccugcgccaaguuuaaaugcgucacaaaacuugagggaaaaaucgugcaguacgaaaaccugaaguauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucucccagaaccggccucgacuucaacgaaaugguucugcuuacgaugaaagagaaguccuggcuggugcauaaacagugguuucucgaucugccucuucccuggacaagcggggcuuccaccucucaagagacauggaaucggcaggaccugcucgucaccuucaagaccgcgcacgccaagaaacaggaaguggucgugcugggaagccaagagggcgcuaugcacacagcccugacgggggccaccgaaauccagacauccggaaccacaaccauuuuugcuggccaucucaagugccgccugaaaauggauaaacuuacgcugaaagggaugagcuauguuauguguacaggcucuuucaagcucgagaaggaaguggccgagacccagcacggaaccguccuggugcagaucaaauacgagggcacagacgcgccgugcaagaucccuuucuccacccaagaugaaaaagggguuacacagaacggaagacugauuacggcuaaucccaucgugaccgacaaggagaaaccugucaacauugaagccgagccgcccuuuggcgagagcuauaucgugauuggggccggagaaaaggcucuuaagcucucuugguucaaaaagggcagcuccaucgggaaaauguuugaggccacagcucggggcgccagacgcauggcgauccugggagauaccgccugggacuucggcucuauugggggaguguuuacaagcguuggcaagcugguccaucagaucuucgggaccgcuuacggagugcucuuuuccggcgugagcuggacgaugaaaauugggaucggcguccugcuuaccuggcugggacucaauucucgguccacaagccugucuaugaccuguauugccgugggccugguuacacuuuaccucggggugaugguccaggcugauuccggaugcgugaucaacuggaagggcagagaacugaagugugggagcggaauuuucguuaccaaugaggugcacacauggaccgaacaauauaaauuucaggccgacuccccuaagcgccugucugcggccaucggcaaggcuugggaggagggggucugcggcauccggagcgccacgagacucgaaaacauuauguggaagcagaucuccaacgagcugaaucauauucuucuggaaaacgacaugaaauucacagugguugugggagaugucgcuggcauccucgcccaggggaagaaaaugauucgcccgcaacccauggaguacaaguauucuuggaaaagcuggggaaaggccaagaucaucggcgcugacgugcagaauaccaccuuuauuaucgaugggccuaacacacccgaauguccugacgaucagcgggcguggaauauuugggagguggaggacuacggauucggcaucuuuaccacgaacauuuggcugaaacugagagauuccuauacacaggucugcgaccaccgccuuaugagcgccgcuaucaaggauucuaaagccguucacgccgacaugggcuacuggaucgaauccgagaagaaugaaaccuggaagcucgcucgggccagcuucauugaggugaaaacauguaucuggcccaagucucauacccugugguccaacggggugcuggaaagcgagaugauuaucccgaaaauuuauggaggcccuaucucucaacacaauuacagacucggguacuucacacagaccgcgggacccuggcaucugggcaaacuugagcuggauuuugaccucugcgaagggacgaccgucgugguugaugagcacugcggaaaccgcggcccuagccugcggacaaccacagugaccggcaaaaucauucacgaaugguguugcagauccuguacgcugcccccucuucgguuccgcggggaggacggaugcugguauggcauggagaucagacccgucaaggaaaaggaggaaaaucucgugaaaagcaugguuucugcuggguccggagagguggacagcuuuucccugggccugcucuguauuucuaucaugauugaagaggucaugcggagcagauggucccgcaagaugcugaugacagggacccuugccguguuccugcuccugaucaugggacagcugacauggaacgaucuuauucggcugugcaucaugguuggcgccaaugcuucugacagaaugggcauggggaccaccuaccucgcccugauggcgacauuuaaaaugcgcccgauguucgcugugggacuccuguuuagacggcuuacgagccgcgagguccugcuccugaccaucggccugucccuuguggccucuguggaacugccuaacagccucgaggaacugggggauggacucgccaugggcauuaugauccugaaacuucugacagacuuccaaucccaucagcucugggcuacccugcugagccuuacauuuauuaaaaccacguucucucugcacuaugccuggaagacaauggcuaugguccucuccaucguuagccuguuuccccucugucugucuaccaccucccagaagacaaccuggcuucccgugcugcuggggagccucggaugcaaaccucugacaauguuccuuauugccgagaauaagaucuggggcagacggucuuggccgcugaacgaaggcaucauggcgguggggauugucuccauccuccugagcucccuccugaaaaacgaugugccccuugccggaccucugauugcuggcgggaugcugaucgccuguuacguuauuagcggaucuagcgcugaccucucccuggagaaggccgccgaggugucuugggaagaggaagcugagcauagcggcgcgucccacaauauccuugucgaagugcaggaugacgggacgaugaaaaucaaggaugaggagcgcgacgauacccugacaauucuccugaaagccacccuccuggcuguuucuggaguguauccccuuagcaucccugccacacuguuugucugguacuucuggcaaaagaagaaacagagauccggcgugcugugggacacccccucuccucccgaagucgagcgggccgugcucgaugacggcauuuaucgcaucaugcagagagggcugcuuggacggagccagguuggcgugggggucuuccaagaaaacguguuucauacgauguggcacguuacccgcggagcugugcugauguaccagggcaagagacucgagccguccugggccagcgucaaaaaggaccugauuucuuacgggggaggcuggcggcuccagggcuccuggaauacaggggaggaaguccaggugaucgcgguugagccuggcaagaaccccaagaauguccaaaccgcuccuggcacauucaagacccccgaaggggaggugggagccauugcccuggauuuuaaaccgggcacaagcgggucuccuaucgugaacagagaaggaaagaucgucggccuuuauggcaauggggugguuacgaccuccggaacauacgugagcgcuauugcccaggcgaaggcuucccaggagggcccccugccugagaucgaagacgaggucuuccgcaagcggaaccugaccauuauggaucuccaccccgggucuggaaaaaccagacgcuaucugcccgccaucgugcgggaagccauuaagagaaaacuucgcacacugauccucgcuccuacgcggguuguggccagcgagauggcugaagcccugaaaggcaugccgaucagauaccaaaccacagcggucaaguccgagcauaccgggaaagagauuguggaccugaugugccacgccacauuuaccaugcgccuccuuagccccguucgggugccuaauuauaacaugaucauuauggaugaagcucauuucacggaccccucuuccaucgccgcuagaggcuacauuagcacacgggucggaaugggcgaggccgccgcuaucuuuaugaccgcgaccccucccgggucuguggaagccuucccucagagcaaugcugugauccaggaugaggaacgcgacauuccggagagauccuggaacucuggauaugaguggaucacagauuuucccggcaagaccgucugguucguuccuagcauuaaauccgggaaugacaucgccaacugucugcggaagaauggaaagcgcgugauucagcugucuagaaaaacauuugauaccgaauaccaaaagacgaaaaacaacgacugggacuacguggucacaaccgauaucagcgagaugggcgccaauuuccgggcugacagagugauugauccccgccggugccucaagccuguuauccugaaagacgggcccgaaagagugauccuugccggcccgaugccugucacaguggcguccgcugcccagcgccggggaagaauuggccgcaaccacaauaaggagggggaucaguauaucuacaugggacagccccugaacaaugacgaggaucaugcccacuggaccgaagcuaagaugcuccuggacaacauuaauacgcccgagggcaucauuccugcccuguucgaacccgagcgggaaaagagcgcggccaucgauggggaguauagacuccgcggagaggcuagaaagaccuuuguugagcuuaugcggcgcggcgaccugccuguguggcugucuuacaaagucgccuccgagggguuccaauauagcgauagacgguggugcuuugacggcgaacgcaacaaucaggugcucgaggaaaacauggaugucgagaucuggacaaaggagggagaacgcaagaagcugcggccgagauggcuugacgcucgcaccuacuccgacccccuggcccuccgggaguucaaagaauuugcugccggcagacgcucugugagcggggaucugauucuggagaucggaaagcucccucagcaccuuacacagcgggcgcaaaaugcccuggacaaccugguuaugcuccauaauuccgaacagggcgggagagcuuaucggcacgccauggaggagcugcccgauaccauugaaacacuuaugcugcucgcucugaucgccgugcugaccggaggcgugacgcuguucuuucuuucuggccgcgggcugggaaagacaagcauuggccugcucugugucauggccuccagcguucugcuuuggauggcuucuguggagccucauuggaucgcggccuccaucauucuggaguucuuucucauggugcugcugauccccgagccggacagacagcggaccccucaggauaaccaacucgcuuacgucgugauugggcuucuguucaugauccugaccguugccgccaaugagaugggacuccuggaaacaaccaaaaaggaccuuggcauugggcacguggcugucggaaaccaccaucacgccgcgaugcuggauguggaccuccaucccgccagcgcuuggacacuguacgccgucgcuacgaccaucauuacaccuaugaugcgccacaccaucgagaacacaaccgccaauaucucucugacggcgauugccaaccaggcugccauccucaugggccuugauaaaggcuggcccauuuccaagauggacaucggggugccucugcuggcucucggaugcuauagccagguuaauccccugacccuuacagccgcugugcugaugcucgucgcccauuacgcgauuaucggcccggggcugcaagccaaagcuaccagagaagcccagaagcggacagcugccggaaucaugaagaacccuaccguggauggcauuguugccaucgaccuggaucccguggucuaugacgcgaaauuugagaagcagcucgggcagauuaugcuucugauccuguguacgucucaaauucuccugaugcgcacaaccugggcucuuugcgaaagcaucacacuggccaccggaccccucaccacacugugggagggcuccccuggcaaauucuggaauacgaccaucgcugugucuauggccaacauuuuuagagggagcuaccuggccggagcuggccucgccuucucccuuaugaaaagccucgggggcgggcggcgcgggacaggagcgcagggcgagacccugggcgaaaaauggaagagacagcucaaucagcuguccaagucugaguucaacacauauaaacggagcgggaucauggaaguggacagauccgaggccaaggaaggacuuaaacgcggcgagaccacgaagcacgcuguuucucgggggacagccaaacugagaugguuugucgagcgcaaucucgugaagccggaaggaaaggugauugaucugggcugugggcggggaggcuggagcuacuauugcgcuggccugaaaaaggucaccgagguuaaaggguacaccaagggaggccccgggcacgaagaaccuauccccauggccacauacggauggaaccucgugaaacuucauuccggcaaggacguguucuuuauuccucccgaaaaaugugauacccugcugugcgacaucggggagucuagcccuaauccgacaauugaggaaggaagaacgcuccgcguccugaagaugguggagcccuggcuucggggcaaccaauucuguaucaagauccugaauccuuauaugcccuccguuguggaaacccucgagcagaugcagagaaaacacggcgggaugcugguccgcaacccucugagcagaaauucuacacaugagauguacuggguguccugcggaaccggcaacauuguuagcgcggugaauaugacaucuagaaugcuccugaaccgcuuuaccauggcccaccggaagcccacguaugaaagagaugucgaccuuggggcuggaacccgccacguggccguggagccggaagucgcuaaccuggauaucauuggccagagaaucgagaauauuaaacaugaacacaaguccacauggcauuacgacgaggauaacccuuauaaaaccugggccuaccacgggagcuaugagguuaagcccucuggauccgcuagcuccauggugaauggcguggucaagcuccugacaaaacccugggacgugaucccuaugguuacccaaaucgccaugacagauaccacgcccuucggccagcagcggguguuuaaggaaaaagucgacacacgcaccccuaaggcgaaaagagggaccgcccaaauuauggaggugacagcuaaguggcuuuggggauuccugagccggaacaagaaaccgagaaucuguacgcgggaagaguuuacccgcaagguuagaucuaaugccgcuauuggcgccguguucgucgacgaaaaccaguggaauagcgccaaagaggcgguggaggaugggcgguuuugggaccucguucaucgcgaaagagagcugcacaagcagggaaaaugcgcuacaugcguguacaacaugaugggcaagcgggaaaagaaacugggggaguucggcaaggccaaaggaucccgcgccaucugguacauguggcucggcgcuagauuucuggaguucgaggcccuuggguucaugaaugaggaucacugguuuucucgggaaaacagccuguccggagucgagggcgaagggcuccauaagcugggauauauucuucgcgacaucucuaaaauccccggcgggaauauguacgcugaugacaccgccggcugggauacaagaauuaccgaggacgaucugcagaacgaggcgcggaucacagacauuauggaaccugagcacgcccuccuggcuaagagcaucuucaaacugaccuaucaaaauaaggugguccgcgugcagagacccgccaagaacggaacgguuauggaugugauuucccggcgcgaccagagaggcucugggcaggucggaaccuacggccucaauacauuuaccaacauggaagcucaacugauccggcagauggagagcgaagggaucuucuccccuagcgagcuugagacacccaaccuggccgaaagagugcucgauuggcuggagaaauauggaguggaacgccuuaagcggauggcgauuucuggcgacgacuguguugugaaaccgaucgaugacagauuugccaccgcucugacggcccucaaugauauggggaagguccgcaaagacauuccucagugggagcccuccaagggcuggaacgauuggcagcaagugccuuucugcagccaucacuuucaccagcugaucaugaaggacggacgggaaauuguugugcccuguagaaaucaggaugagcuggucggccgcgcucgggugucucagggggccggauggucccucagagagacagcuugccugggcaaaagcuacgcccaaauguggcagcuuauguauuuccaucgccgggaccugagacucgcggccaacgcuaucuguuccgccgucccuguggauuggauucccaccucucgcacaaccuggagcauccacgcccaucaccaguggaugacgaccgaagacaugcuguccguuuggaaucggguguggaucgaggaaaacccguggauggaggauaagacacauauuagcucuuggggagacgucccuuaccuuggaaaaagagaagaccaauggugcggcucccugaucgggcucaccgcucgggccacaugggcgaccaauauucagguggcuaucaaccagguuagacgccugauuggcaaugagaacuaccuggauuauaugacaagcaugaagcgguuuaaaaaugagucugaccccgaaggagcccucugguga

SEQ ID NO: 18587 - RNA, 9879 nt, Artificial Sequence
  derived and/or modified CDS sequence (opt5) from DENV-1__HM181954__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccauucugcgcaaacuuugcaucgaagcgaagauuuccaauaccacgacagauagcagauguccgacccaaggagaggccacccugguugaagagcaggacgcuaacuucgugugccggcgcacauuuguggauagaggcuggggcaauggguguggacucuucggcaaagggucucugaucaccugcgccaaguuuaagugcgucacaaaacuugagggaaagaucgugcaguacgaaaaccugaaauauuccguuauugugacgguccacaccggcgaccagcaucaaguggggaaugagagcacagaacacggaaccacagcuaccaucacgccccaggccccuaccacagagauucagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaccgggggcuagcaccucccaagagacauggaaucgccaggaccugcucgucaccuucaaaaccgcgcacgccaagaagcaggaaguggucgugcugggaucucaagagggcgcuaugcacacagcccugacgggggccaccgaaauccagacaagcggaaccacaaccauuuuugcuggccaucucaaaugcagacugaagauggauaaacuuacgcugaaggggauguccuauguuauguguacaggcagcuucaaacucgagaaggaaguggccgagacccagcacggaaccguccuggugcagaucaaguacgagggcacagacgcgccuugcaaaauccccuucucuacccaagaugaaaaggggguuacacagaacggacggcugauuacggcuaauccuaucgugaccgacaaagagaagcccgucaacauugaagccgagcccccuuuuggcgaguccuauaucgugauuggggccggagaaaaagcucuuaagcucagcugguucaagaaaggcucuagcaucgggaagauguuugaggccacagcuagaggcgcccgccggauggcgauccugggagauaccgccugggacuucggcuccauugggggaguguuuacaucuguuggcaaacugguccaucagaucuucggggcugccuacggagugcucuuuagcggcguguccuggaccaugaagauugggaucggcguccugcuuacguggcugggacucaauagcagaucuaccucccugagcaugacauguauugcugugggccugguuacccuuuaccucggggugaugguccaggccgauucuggaugcgugaucaacuggaaaggccgcgaacugaaguguggguccggaauuuucguuacaaaugaggugcacaccuggacagaacaauauaaguuucaggcggacagcccgaaacggcuguccgccgcuaucggcaaggccugggaggagggggucugcggcaucagaucugcuacccgccucgaaaacauuauguggaaacagaucagcaacgagcugaaucauauucuucuggaaaacgacaugaaguucacggugguugugggagaugucgccggcauccucgcccaggggaaaaagaugauucggccccaaccuauggaguacaaauauuccuggaagucuuggggaaaggcuaaaaucaucggcgcggacgugcagaauacaaccuuuauuaucgaugggcccaacaccccugaaugucccgacgaucagagagccuggaauauuugggagguggaggacuacggauucggcaucuuuacaaccaacauuuggcugaagcugcgcgauagcuauacgcaggcuugcgaccaccggcuuauguccgccgccaucaaagauagcaaggcuguccacgccgacaugggcuacuggaucgaaucugagaaaaaugaaacauggaagcucgcgagagcuuccuucauugagguuaagaccuguaucuggccgaaaagccauacacuguggucuaacggggugcuggaauccgagaugauuaucccuaagauuuauggaggccccaucagccaacacaauuaccgcccuggguacuucacccagacagccggacccuggcaucucggcaaacuggagcuugauuuugaccugugcgaagggaccacgguggucguggaugagcacugcggaaaccggggcccuucucucagaaccacaaccguuacaggcaagaucauucacgaaugguguugccggagcuguacccugcccccgcugcgcuucagaggggaggacggaugcugguauggcauggagauccggccugugaaagaaaaggaggaaaaucuugucaaguccauggugagcgccgggucuggagagguugacuccuuuagccucggccugcuguguauuuccaucaugauugaagaggugaugagaucucgcuggagccggaaaaugcucaugacggggacacuggcugucuuccuucugcucaucaugggacagcugaccuggaacgaucugauuagacuuugcaucauggugggcgccaaugcguccgaccgcaugggcauggggacaaccuaccuggcucucauggccaccuuuaagaugagacccauguucgccguuggacugcucuuucggcgccugacaucuagagaggugcuucugcucacgaucggccugagccuggucgcuuccguggaacuucccaacucucuggaggaacucggggauggacuggccaugggcauuaugauccucaaacugcuuaccgacuuccaaagccaucagcugugggcuacacuccugucccugaccuuuauuaagacaaccuucagccuucacuaugccuggaaaacgauggcgauggugcugucuaucgucucccucuuuccucugugucucagcacaaccucucagaagaccacauggcugccgguucuucuggggucccugggaugcaagccccucaccauguuccugauugccgagaauaaaaucuggggccggcgcagcuggccucuuaacgaaggcaucauggcuguggggauugugucuauccugcucuccagccugcucaagaacgaugucccccuggccggaccucuuauugcuggcgggaugcugaucgccuguuacgugauuuccggaagcucugccgaccugagccucgagaaagcugcggagguuuccugggaagaggaagccgagcauucuggcgcuagccacaauauccugguggaaguccaggaugacgggacaaugaagaucaaagaugaggagagagacgauacgcuuaccauucugcucaaggccacacugcucgccguguccggaguuuauccccugucuaucccugcuacccuuuuugugugguacuucuggcaaaaaaagaagcagcggagcggcguccugugggacacacccuccccgccugaaguggagcgcgccguccuggaugacggcauuuauagaaucaugcagcgggggcuccugggacgcucucaggugggcguugggguguuccaagaaaacgucuuucauaccauguggcacgugacgagaggagcgguucuuauguaccagggcaaacggcuggagcccagcugggcuuccgugaagaaagaccucauuagcuacgggggaggcuggagacugcagggcucuuggaauaccggggaggaaguccaggugaucgccguggagccuggaaagaaccccaaaaauguucaaacagccccgggcaccuucaagacaccugaaggggaggucggagcuauugcccucgauuuuaagcccggcaccuccgggagcccuaucgugaaccgcgaaggaaaaaucgugggccuguauggcaauggggucgugacaacgucuggaaccuacguuuccgcgauugcucaggccaaggccagccaggagggcccccuucccgagaucgaagacgagguguuccggaaaagaaaccugacaauuauggaucugcacccuggguccggaaagacccgccgguaucucccggcuaucgucagagaagccauuaaacgcaagcugcggacccuuauccuggcucccacaagagugguugccucugagauggcggaagcccucaagggcaugccuauccgcuaccaaacgaccgcugugaaaagcgagcauacagggaaggagauugucgaccugaugugccacgccaccuuuacaaugcggcugcucucccccgugagaguuccuaauuauaacaugaucauuauggaugaagcucauuucaccgaccccagcucuaucgccgcccggggcuacauuuccacgcgcgugggaaugggcgaggcugcggccaucuuuaugacagcuaccccuccggggagcgucgaagccuucccccagucuaaugccgugauccaggaugaggaaagagacauuccugagcggagcuggaacuccggauaugaguggaucaccgauuuucccggcaaaacagugugguucgucccuucuauuaagagcgggaaugacaucgcuaacugucuucgcaaaaauggaaagagaguuauucagcugucccggaagaccuuugauacagaauaccaaaaaaccaagaacaacgacugggacuacguggugacgacagauaucucugagaugggcgccaauuucagagcggaccgcgucauugauccccggagaugccugaaaccggugauccucaaggacgggccugaacgcguuauccuggcuggccccaugcccgugaccgucgccagcgccgcucagcggagaggacgcauuggccggaaccacaauaaagagggggaucaguauaucuacaugggacagccucuuaacaaugacgaggaucaugcccacuggacagaagcgaagaugcugcucgacaacauuaauacccccgagggcaucauuccugcccuguucgaaccggagagagaaaaguccgcugccaucgauggggaguaucgccugagaggagaggcucggaaaacguuuguggaacucaugcgcagaggcgaccuucccguuuggcugagcuacaagguggccucugagggguuccaauauuccgaucggcgcuggugcuuugacggcgaaagaaacaaucagguccuggaggaaaacauggauguggagaucuggaccaaagagggagaacggaagaaacucagaccucgcuggcuggacgcucggacauacagcgacccccuugcccugagagaguucaaggaauuugcggccggccgccgguccgucucuggggaucucauucuggagaucggaaaacugccucagcaccucacccagagagcucaaaaugcccuugacaaccuggugaugcugcauaauagcgaacagggcgggcgggcuuaucgccacgccauggaggagcuccccgauacaauugaaacccugaugcuucuggcccucaucgcuguucugacaggaggcgugacccuguucuuucucuccggcagagggcuuggaaagacgucuauuggccugcugugugugauggcgagcuccguccuccuguggauggccagcguugagccgcauuggaucgcugccucuaucauucuugaauucuuucugauggugcuccugaucccugagcccgaccggcagcgcacaccucaggauaaccaacuggccuacguggucauugggcuccuuuucaugauccugaccguggcugccaaugagaugggacugcucgaaaccacaaagaaagaccugggcauugggcacguugcggugggaaaccaccaucacgccgcuaugcuugaugucgaccugcaucccgccuccgcuuggacccucuacgccguggcgacaacgaucauuaccccuaugaugagacacacaaucgagaacaccacagccaauaucagccugaccgcuauugccaaccaggcugccauccugaugggccucgauaagggcuggcccauuucuaaaauggacaucggggucccgcuucuggcucugggaugcuauucccaggugaauccucucacgcugaccgccgcgguucuuaugcugguggcccauuacgcuauuaucggccccgggcuccaagccaaggcuacacgggaagcccagaaacgcaccgccgcgggaaucaugaagaaccccacagucgauggcauuguggcuaucgaccuggauccuguuguguaugacgccaaguuugagaaacagcuggggcagauuaugcuccuuauccuguguaccagccaaauucugcucaugagaacgacaugggcucugugcgaaucuaucacccuugccacaggaccgcugaccacccucugggagggcagccccggcaaguucuggaauacaacgaucgccgucuccauggcuaacauuuuucgggggucuuaccuggccggagcgggccuggccuucagccucaugaaaucccuugggggaggccgcagagggaccggagcucagggcgagacacugggcgaaaaguggaaacggcagcugaaucagcucagcaaguccgaguucaacaccuauaagagaucugggaucauggaaguggaccgcagcgaggccaaagaaggacugaagcggggcgagacaaccaaacacgcuguguccagagggacggccaagcuucgcugguuuguugagcggaaucuggucaaaccugaaggaaaggugauugaucucggcugugggagaggaggcuggucuuacuauugcgcgggccugaagaaagugacagaggucaagggguacaccaaaggaggccccgggcacgaagagccuauccccauggccaccuacggauggaaccugguuaagcuccauagcggcaaagacguguucuuuauuccuccggaaaagugugauacacuucugugcgacaucggggaguccucucccaauccuaccauugaggaaggacgcacacugcgggugcucaaaauggucgagcccuggcugagaggcaaccaauucuguaucaagauccuuaauccuuauaugcccagcgugguugaaacgcuggagcagaugcagcgcaagcacggcgggaugcucgugcggaacccgcuguccagaaauagcacccaugagauguacugggucucuugcggaacaggcaacauuguguccgcuguuaauaugaccagccgcaugcugcucaaccgguuuacaauggcccacagaaaaccuaccuaugaacgcgauguggaccugggggcuggaacgagacacgucgccguggagcccgaaguggcuaaccuugauaucauuggccagcggaucgagaauauuaagcaugaacacaaaucuaccuggcauuacgacgaggauaaccccuauaagacaugggccuaccacggguccuaugaggucaaaccuagcggaucugcguccagcaugguuaauggcguggugaagcugcucaccaagcccugggacgucaucccuauggugacacaaaucgccaugaccgauacaaccccguucggccagcagcgcguuuuuaaagaaaagguggacacgagaacacccaaagcuaagcgggggaccgcccaaauuauggaggucaccgcuaaauggcuguggggauuccuuuccagaaacaagaagccucggaucuguacacgcgaagaguuuacgagaaaagugcggagcaaugccgccauuggcgcgguuuucguggacgaaaaccaguggaauucugcuaaggaggccgucgaggaugaacgcuuuugggaccuggugcauagagagcgggaacuccacaaacaggggaagugcgccaccugcguuuacaacaugaugggaaaacgcgagaagaagcugggcgaauucgggaaagcuaagggcagcagagccaucugguacauguggcugggagcucgguuucucgaguucgaggcccugggcuucaugaaugaagaucacugguuuucccgcgagaacucucuuagcgggguggaaggagagggccugcauaaacucggguauauucugagagacaucuccaagauccccggaggcaauauguacgcggaugacacagccgggugggauacccggauuacagaggacgaucuucagaacgaagcucgcaucaccgacauuauggagccugaacacgcccugcucgcuaaaucuaucuucaagcugacauaucaaaauaaagucgugagaguccagcggcccgccaagaacggcaccgugauggauguuauuagccgcagagaccagcggggauccggccagguggggacguacggacugaauaccuuuacaaacauggaggcgcaacucaucagacagauggaaucugagggcaucuucagcccguccgagcuggaaaccccuaaccuugccgagcgcguccuggauuggcucgaaaaguaugggguggagcggcugaaaagaauggcuauuagcggagacgacugugugguuaagcccaucgaugaccgcuuugccacagcucuuaccgcccugaaugauaugggcaaagugcggaaggacauuccucagugggaacccucuaaaggguggaacgauuggcagcaagucccuuucugcucccaucacuuucaccagcucaucaugaaggacggcagagagauugugguucccugucgcaaucaggaugagcuggugggacgggcuagagucagccagggcgccggguggucucugcgcgaaacggcgugccucggaaaguccuacgcccaaauguggcagcugauguauuuccaucggagagaccuucgccuggcugccaacgccaucuguagcgcugugccggucgauuggauuccuacaucccggaccacauggucuauccacgcccaucaccaguggaugaccacggaggacaugcucagcguguggaauagaguuuggaucgaagagaaccccuggauggaagauaaaacccauauuuccagcuggggcgacgugcccuaccuggggaagcgggaggaccaauggugcggaucucuuaucggccugacagcgagagcuaccugggccacaaauauucaggucgccaucaaccaggugcgccggcucauugggaaugagaacuaccuggauuauaugaccuccaugaaaagauuuaagaaugaaagcgacccugagggcgcucugugguga

SEQ ID NO: 18588 - RNA, 9879 nt, Artificial Sequence
  derived and/or modified CDS sequence (opt5) from DENV-1__HM181955__SS-prME
agcgugaccaugcugcucaugcugaugcccacagcccuugcuuuccaccugacgaccagaggcggggagccucauaugaucgucuccaagcaggaacgggggaaaucucuccuguuuaagaccagcgccggcguuaauaugugcacccuuaucgcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagucugccuggaaacagauucagcggguugaaacaugggcucugcgccaccccggcuucaccgugaucgcccuuuuucuggcgcaugccauuggcacaagcaucacccagaaggggaucauuuucauccuccugaugcuugucaccccuuccauggcuaugagaugcgugggaauuggcagccgggauuuuguugaggggcugucuggagccacauggguggacgucgugcucgagcacggcuccugugugacgaccauggcuaaggauaaacccacacuggacaucgaacugcucaagaccgaggucacaaacccugccauucugcgcaaacuuugcaucgaagcgaagauuagcaauaccacgacagauucuagauguccgacccaaggggaggccacccugguugaagaacaagacgcuaacuucgugugccggcgcacauuuguggauagaggauggggcaauggcuguggacucuucggaaaaggcucccugauuaccugcgccaaguuuaagugcgucacaaaacuugaggggaagaucgugcaguacgaaaaccugaaauauagcguuauugugacgguccacaccggagaccagcaucaagugggcaaugagucuacagaacacgggaccacagcuaccaucacgccccaggccccuaccacagagauucagcucaccgacuacggagcccugacacuggauuguagcccccggaccggccucgacuucaacgaaaugguucugcuuacgaugaaggagaaaagcuggcuggugcauaagcagugguuucucgaucugccucuucccuggacauccggcgcuucuaccagccaagagacauggaaucgccaggaccugcucgucaccuucaaaaccgcgcacgccaagaagcaggaaguggucgugcuggggucccaagagggagcuaugcacacagcccugacgggcgccaccgaaauccagacaagcgggaccacaaccauuuuugcuggacaucucaaaugcagacugaagauggauaaacuuacgcugaagggcaugucuuauguuauguguacaggguccuucaaacucgagaaggaaguggccgagacccagcacggcaccguccuggugcagaucaaguacgagggaacagacgcgccgugcaaaaucccuuucagcacccaagaugaaaagggcguuacacagaacgggcggcugauuacggcuaaucccaucgugaccgacaaagagaagccugucaacauugaagccgagccgcccuuuggagagucuuauaucgugauuggcgccggggaaaaagcucuuaagcucagcugguucaagaaaggauccucuaucggcaagauguuugaggccacagcuagaggggcccgccggauggcgauccugggcgauaccgccugggacuucggaagcauuggcgggguguuuacauccguuggaaaacugguccaucagaucuucggcaccgcuuacggggugcucuuuagcggagugucuuggacgaugaagauuggcaucgggguccugcuuaccuggcugggccucaauuccagaagcacaucucuguccaugaccuguauugccgugggacugguuacacuuuaccucggcgugaugguccaggcugauagcgggugcgugaucaacuggaaaggacgcgaacugaaguguggcuccgggauuuucguuaccaaugaggugcacacauggaccgaacaauauaaguuucaggccgacucuccuaaacggcugagcgcggccaucggaaaggcuugggaggagggcgucugcgggaucagauccgccacgcgccucgaaaacauuauguggaaacagaucucuaacgagcugaaucauauucuucuggaaaacgacaugaaguucacagugguugugggcgaugucgcuggaauccucgcccagggcaaaaagaugauucggccgcaacccauggaguacaaauauagcuggaaguccugggggaaggccaaaaucaucggagcugacgugcagaauaccaccuuuauuaucgauggcccuaacacacccgaauguccugacgaucagagagcguggaauauuugggagguggaggacuacggguucggaaucuuuaccacgaacauuuggcugaagcugcgcgauagcuauacacaggucugcgaccaccggcuuaugucugccgcuaucaaagauuccaaggccguucacgccgacaugggcuacuggaucgaaagcgagaaaaaugaaaccuggaagcucgcuagagccucuuucauugaggugaagacauguaucuggcccaaaucccauacccuguggagcaacggcgugcuggaaucugagaugauuaucccgaagauuuaugggggaccuaucagccaacacaauuaccgccccggcuacuucacacagaccgcggggccuuggcaucucggaaaacuggagcuugauuuugaccugugcgaaggcacgaccgucgugguugaugagcacugcgggaaccggggacccucccucagaacaaccacagugaccggcaagaucauucacgaaugguguugccggagcuguacgcugccuccccugcgcuucagaggcgaggacgggugcugguauggaauggagauccggccggucaaagaaaaggaggaaaaucuugugaagucuaugguuuccgcuggcagcggggagguggacuccuuuucucucggacugcuguguauuagcaucaugauugaagaggucaugagaucccgcuggucucggaaaaugcucaugacaggcacccuggugguuuuccuucugcucaucauggggcagcugacauggaacgaucugauuagacuuugcaucauggugggagccaaugccagcgaccgcaugggcaugggcaccaccuaccuggcucucauggccacauuuaagaugagaccuauguucgcggucgggcugcucuuucggcgccugacguccagagaggugcuucugcucaccaucggacugucucugguggcuagcgucgaacuucccaacucccuggaggaacucggcgaugggcuggccaugggaauuaugauccucaaacugcuuacagacuuccaaagccaucagcugugggccacccuccugucucugacauuuauuaagaccacguucucccuucacuaugcuuggaaaacaauggccaugguucugagcaucgugucucucuuuccccugugucucuccaccaccagccagaagacaaccuggcugccugugcuucugggcucucuggggugcaagccgcucacaauguuccugauugcugagaauaaaaucuggggacggcgcuccuggccccuuaacgaaggcaucauggccgucggcauugugagcauccugcucuccagccugcucaagaacgauguuccucuggcggggccccuuauugccggaggcaugcugaucgcuuguuacgugauuucugggagcuccgccgaccugucucucgagaaagcugccgaggucagcugggaagaggaagccgagcauuccggagcuucucacaauauccugguggaaguucaggaugacggcacgaugaagaucaaagaugaggagagagacgauacccuuacaauucugcucaaggcgacccugcucgccgugagcggggucuauccucuguccauccccgcuacacuuuuugugugguacuucuggcagaagaagaagcagcggucuggaguccugugggacaccccuuccccucccgaaguggagcgcgccguucuggaugacggcauuuauagaaucaugcagcggggccuccuggggcgcucccaggugggagucggcguguuccaagaaaacguuuuucauacgauguggcacgugaccagaggggccguccuuauguaccagggaaaacggcuggagcccagcugggcuucugugaagaaagaccucauuuccuacggcgggggauggagacugcagggcagcuggaauacaggcgaggaagugcagguuaucgccgucgagcccgggaagaacccuaaaaaugugcaaaccgcgcccggaacauucaagaccccggaaggcgaggugggggcuauugcccucgauuuuaagccuggaacaucuggcucccccaucgucaaccgcgaagggaaaaucgugggacuguauggcaauggcguugugacgaccagcgggacauacgucuccgccauugcucaggccaaggcgucucaggagggaccucuucccgagaucgaagacgagguguuccggaaaagaaaccugaccauuauggaucugcaccccggcagcgggaagacccgccgguaucucccugcuaucguuagagaagccauuaaacgcaagcugcggacacuuauccuggccccgacgagaguggucgcuuccgagauggccgaagcucucaagggaaugcccauccgcuaccaaaccacagccgugaaaagcgagcauaccggcaaggagauuguugaccugaugugccacgcgacauuuaccaugcggcugcucucuccugugagaguccccaauuauaacaugaucauuauggaugaagcccauuucacggacccuuccagcaucgcugcccggggguacauuucuacacgcgugggcaugggagaggcugccgccaucuuuaugaccgcuacacccccuggcagcguggaagcguucccgcaguccaaugccgucauccaggaugaggaaagagacauucccgagcggucuuggaacagcggguaugaguggaucacagauuuuccuggaaaaaccguuugguucgugcccuccauuaagucuggcaaugacaucgcuaacugucuucgcaaaaaugggaagagagugauucagcugagccggaagacauuugauaccgaauaccagaaaacgaagaacaacgacugggacuacgucgugacaaccgauaucuccgagaugggagccaauuucagagccgaccgcguuauugauccucggagaugccugaaacccgugauccucaaggacggcccggaacgcgucauccuggcugggccuaugcccgugacaguugccagcgcggcucagcggagaggccgcauuggacggaaccacaauaaagagggcgaucaguauaucuacauggggcagccccuuaacaaugacgaggaucaugcccacuggaccgaagccaagaugcugcucgacaacauuaauacgccugagggaaucauucccgcucuguucgaaccugagagagaaaagucugccgcgaucgauggcgaguaucgccugagaggggaggcccggaaaaccuuuguggaacucaugcgcagaggagaccuuccggucuggcuguccuacaagguggcuagcgagggcuuccaauauuccgaucggcgcuggugcuuugacggggaaagaaacaaucagguccuggaggaaaacauggauguggagaucuggacaaaagagggcgaacggaagaaacucagaccccgcuggcuggacgcccggaccuacucugacccucuugcucugagagaguucaaggaauuugccgcuggacgccggagcguuuccggcgaucucauucuggagaucgggaaacugccccagcaccucacacagagagcccaaaaugcgcuugacaaccuggugaugcugcauaauucugaacagggaggccgggccuaucgccacgcuauggaggagcucccugauaccauugaaacacugaugcuucuggcccucaucgcugugcugaccgggggagucacgcuguucuuucucagcggcagaggccuugggaagacauccauuggacugcuguguguuauggccagcucugugcuccuguggauggccuccguggagccccauuggaucgcugcgagcaucauucuugaguucuuucugaugguccuccugaucccggagccugaccggcagcgcacaccccaagauaaccaacuggccuacgugguuauuggccuccuuuucaugauccugaccguggcugccaaugagauggggcugcucgaaaccaccaagaaagaccugggaauuggccacgucgccguggggaaccaccaucacgcugccaugcuugaugucgaccugcauccugcgucugccuggacacucuacgcuguggccacgaccaucauuacacccaugaugagacacaccaucgagaacacaaccgcuaauaucucccugacggccauugcgaaccaggccgcuauccugaugggacucgauaagggcuggccuauuagcaaaauggacaucggcguuccccuucuggcccuggggugcuauucucaggugaauccgcucacccugacagcugccguccuuaugcugguggcucauuacgccauuaucggaccuggccuccaagcgaaggccacccgggaagcucagaaacgcacagccgcugggaucaugaagaaccccaccguugauggaauuguggccaucgaccuggaucccgucguguaugacgccaaguuugagaaacagcugggccagauuaugcuccuuauccuguguacgagccaaauucugcucaugagaacaaccugggcgcugugcgaauccaucacacuugcuaccgggccucugaccacacucugggagggaucuccgggcaaguucuggaauacgaccaucgccgugagcauggcuaacauuuuucggggcuccuaccuggccggggccggacuggcuuucagccucaugaaaucccuuggcgggggacgcagaggcacaggggcccagggagagacccugggcgaaaaguggaaacggcagcugaaucagcucucuaagagcgaguucaacacauauaagagauccggcaucauggaaguugaccgcucugaggcgaaagaagggcugaagcggggagagaccacgaaacacgccgucagcagaggcacagcuaaacuucgcugguuuguggagcggaaucuggugaaacccgaagggaaggucauugaucucggauguggcagagggggaugguccuacuauugcgccggccugaagaaaguuaccgaggugaagggcuacaccaaagggggaccuggccacgaagaacccaucccuauggcuacauacggguggaaccuggugaagcuccauucuggaaaagacgucuucuuuauucccccugaaaagugugauacccuucugugcgacaucggcgagagcuccccgaaucccacaauugaggaagggcgcacgcugcgggugcucaaaaugguugagccuuggcugagaggaaaccaauucuguaucaagauccuuaaucccuauaugccuagcguggucgaaacccuggagcagaugcagcgcaagcacggcggcaugcucgugcggaacccccugucuagaaauuccacacaugagauguacuggguuagcugcgggaccggaaacauugugucugccgucaauaugacaucccgcaugcugcucaaccgguuuaccauggcgcacagaaaaccgacguaugaacgcgauguggaccugggcgccgggaccagacacguggcugucgagccugaaguugccaaccuugauaucauuggacagcggaucgagaauauuaagcaugaacacaaaagcacauggcauuacgacgaggauaaccccuauaagaccugggcuuaccacggcucuuaugaggugaaacccuccgggagcgccuccagcauggugaauggagucgugaagcugcucacaaagccuugggacguuauccccauggugacccaaaucgcuaugacagauaccacgccuuucggccagcagcgcgucuuuaaagaaaagguggacacaagaaccccgaaagccaagcggggcaccgcgcaaauuauggagguuacagccaaauggcuguggggguuccuuucuagaaacaagaagccccggaucuguacgcgcgaagaguuuaccagaaaagugcggagcaaugcugccauuggagcugucuucguggacgaaaaccaguggaacuccgccaaggaggccguugaggaugaacgcuuuugggaccuggugcauagagagcgggaacuccacaaacagggcaagugcgcgacaugcgucuacaacaugauggggaaacgcgagaagaagcugggagaguucggcaaagcuaaggggucuagagccaucugguacauguggcugggcgcccgguuucucgaguucgaggcucugggauucaugaaugaagaucacugguuuagccgcgagaacucccuuucuggcguggaaggggagggacugcauaaacucggcuauauucugagagacaucagcaagaucccugggggaaauauguacgccgaugacaccgcuggcugggauacacggauuaccgaggacgaucuucagaacgaagcccgcaucacagacauuauggagcccgaacacgcgcugcucgccaaauccaucuucaagcugaccuaucaaaauaaagucgugagaguucagcggccugcuaagaacgggacggugauggaugucauuucucgcagagaccagcggggcagcggacaggugggcaccuacgggcugaauacauuuaccaacauggaggcccaacucaucagacagauggaauccgagggaaucuucagccccucugagcuggaaacaccgaaccuugcugagcgcgugcuggauuggcucgaaaaguauggcguugagcggcugaaaagaauggccauuuccggggacgacuguguggucaagccuaucgaugaccgcuuugcgaccgcccuuacggcucugaaugauaugggaaaagugcggaaggacauuccccagugggaaccuagcaaaggcuggaacgauuggcagcaaguucccuucugcucucaucacuuucaccagcucaucaugaaggacgggagagagauuguggucccuugucgcaaucaggaugagcuggugggccgggccagagucucccagggagcuggcuggagccugcgcgaaacagccugccucgggaaguccuacgcucaaauguggcagcugauguauuuccaucggagagaccuucgccuggccgcgaacgccaucuguucugcugugcccguugauuggauuccgaccagccggacaaccugguccauccacgcccaucaccaguggaugacgaccgaggacaugcucagcguguggaauagagucuggaucgaagagaacccuuggauggaagauaaaacacauauuucuuccuggggagacgugcccuaccugggcaagcgggaggaccaauggugcgggagccuuaucggacugaccgccagagcuacaugggccaccaauauucagguugcgaucaaccaggugcgccggcucauuggcaaugagaacuaccuggauuauaugacaucuaugaaaagauuuaagaaugaaagcgaccccgagggggcucugugguga

SEQ ID NO: 18589 - RNA, 9879 nt, Artificial Sequence
  derived and/or modified CDS sequence (opt5) from DENV-1__HM181959__SS-prME
agcgugaccaugcugcucaugcugaugcccacagcccuugcuuuccaccugacgaccagaggcggggagccucauaugaucgucuccaagcaggaacgggggaaaucucuccuguuuaagaccagcgccggcguuaauaugugcacccuuaucgcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagucugccuggaaacagauccagcggguugaaacaugggcucugcgccaccccggcuucaccgugaucgcccuuuuucuggcgcaugccauuggcacaagcaucacccagaaggggaucauuuucauccuccugaugcuugucaccccuuccauggcuaugagaugcgugggaauuggcagccgggauuuuguugaggggcugucuggagccacauggguggacgucgugcucgagcacggcuccugugugacgaccauggcuaaggauaaacccacacuggacaucgaacugcucaagaccgaggucacaaacccugccauucugcgcaaacuuugcaucgaagcgaagauuagcaauaccacgacagauucuagauguccgacccaaggggaggccacccugguugaagaacaagacgcuaacuucgugugccggcgcacauuuguggauagaggauggggcaauggcuguggacucuucggaaaaggcucccugauuaccugcgccaaguuuaagugcgucacaaaacuugaggggaagaucgugcaguacgaaaaccugaaauauagcguuauugugacgguccacaccggagaccagcaucaagugggcaaugagucuacagaacacgggaccacagcuaccaucacgccccaggccccuaccacagagauucagcucaccgacuacggagcccugacacuggauuguagcccccggaccggccucgacuucaacgaaaugguucugcuuacgaugaaggagaaaagcuggcuggugcauaagcagugguuucucgaucugccucuucccuggacauccggcgcuucuaccagccaagagacauggaaucgccaggaccugcucgucaccuucaaaaccgcgcacgccaagaagcaggaaguggucgugcuggggucccaagagggagcuaugcacacagcccugacgggcgccaccgaaauccagacaagcgggaccacaaccauuuuugcuggacaucucaaaugcagacugaagauggauaaacuuacgcugaagggcaugucuuauguuauguguacaggguccuucaaacucgagaaggaaguggccgagacccagcacggcaccguccuggugcagaucaaguacgagggaacagacgcgccgugcaaaaucccuuucagcacccaagaugaaaagggcguuacacagaacgggcggcugauuacggcuaaucccaucgugaccgacaaagagaagccugucaacauugaagccgagccgcccuuuggagagucuuauaucgugauuggcgccggggaaaaagcucuuaagcucagcugguucaagaaaggauccucuaucggcaagauguuugaggccacagcuagaggggcccgccggauggcgauccugggcgauaccgccugggacuucggaagcauuggcgggguguuuacauccguuggaaaacugguccaucagaucuucggcaccgcuuacggggugcucuuuagcggagugucuuggacgaugaagauuggcaucgggguccugcuuaccuggcugggccucaauuccagaagcacaucucuguccaugaccuguauugccgugggacugguuacacuuuaccucggcgugaugguccaggcugauagcgggugcgugaucaacuggaaaggacgcgaacugaaguguggcuccgggauuuucguuaccaaugaggugcacacauggaccgaacaauauaaguuucaggccgacucuccuaaacggcugagcgcggccaucggaaaggcuugggaggagggcgucugcgggaucagauccgccacgcgccucgaaaacauuauguggaaacagaucucuaacgagcugaaucauauucuucuggaaaacgacaugaaguucacagugguugugggcgaugucgcuggaauccucgcccagggcaaaaagaugauucggccgcaacccauggaguacaaauauagcuggaaguccugggggaaggccaaagugaucggagcugacgugcagaauaccaccuuuaucauugauggcccuaacacacccgaauguccugacgaucagagagcguggaauaucugggaggucgaggacuacggguucggaauuuuuaccacgaacaucuggcugaagcugcgcgauagcuauacacagguuugcgaccaccggcuuaugucugccgcuauuaaagauuccaaggccgugcacgccgacaugggcuacuggaucgaaagcgagaaaaaugaaaccuggaagcucgcuagagccucuuucaucgaggugaagacauguauuuggcccaaaucccauacccuguggagcaacggcguccuggaaucugagaugaucauuccgaagaucuaugggggaccuauuagccaacacaauuaccgccccggcuacuucacacagaccgcggggccuuggcaucucggaaaacuggagcuugauuuugaccugugcgaaggcacgaccgugguuguggaugagcacugcgggaaccggggacccucccucagaacaaccacagucaccggcaagaucauccacgaaugguguugccggagcuguacgcugccuccccugcgcuucagaggcgaggacgggugcugguauggaauggagauucggccggugaaagaaaaggaggaaaaucuuguuaagucuaugguguccgcuggcagcggggaggucgacuccuuuucucucggacugcuguguaucagcauuaugaucgaagaggugaugagaucccgcuggucucggaaaaugcucaugacaggcacccugguuguguuccuucugcucauuauggggcagcugacauggaacgaucugaucagacuuugcauuauggucggagccaaugccagcgaccgcaugggcaugggcaccaccuaccuggcucucauggccacauuuaagaugagaccuauguucgcgguggggcugcucuuucggcgccugacguccagagaggugcuucugcucaccaucggacugucucuggucgcuagcguugaacuucccaacucccuggaggaacucggcgaugggcuggccaugggaaucaugauucucaaacugcuuacagacuuccaaagccaucagcugugggccacccuccugucucugacauuuaucaagaccacguucucccuucacuaugcuuggaaaacaauggccauggugcugagcauugugucucucuuuccccugugucucuccaccaccagccagaagacaaccuggcugccuguccuucugggcucucuggggugcaagccgcucacaauguuccugaucgcugagaauaaaauuuggggacggcgcuccuggccccuuaacgaaggcaucauggccgugggcaucguuagcauucugcucuccagccugcucaagaacgaugugccucuggcggggccccuuaucgccggaggcaugcugauugcuuguuacgucaucucugggagcuccgccgaccugucucucgagaaagcugccgaggugagcugggaagaggaagccgagcauuccggagcuucucacaauauucugguugaagugcaggaugacggcacgaugaagaucaaagaugaggagagagacgauacccuuacaauccugcucaaggcgacccugcucgccgucagcgggguguauccucuguccauucccgcuacacuuuuugucugguacuucuggcagaagaagaagcagcggucuggagugcugugggacaccccuuccccucccgaaguugagcgcgccgugcuggaugacggcaucuauagaauuaugcagcggggccuccuggggcgcucccaggucggagugggcguuuuccaagaaaacguguuucauacgauguggcacgucaccagaggggccgugcuuauguaccagggaaaacggcuggagcccagcugggcuucugugaagaaagaccucaucuccuacggcgggggauggagacugcagggcagcuggaauacaggcgaggaaguucaggucauugccguggagcccgggaagaacccuaaaaaugugcaaaccgcgcccggaacauucaagaccccggaaggcgaggucggggcuaucgcccucgauuuuaagccuggaacaucuggcucccccauugugaaccgcgaagggaaaaucguuggacuguauggcaauggcguggucacgaccagcgggacauacguguccgccaucgcucaggccaaggcgucucaggagggaccucuucccgagauugaagacgagguuuuccggaaaagaaaccugaccaucauggaucugcaccccggcagcgggaagacccgccgguaucucccugcuauugugagagaagccaucaaacgcaagcugcggacacuuauucuggccccgacgagagucguggcuuccgagauggccgaagcucucaagggaaugcccauccgcuaccaaaccacagccguuaaaagcgagcauaccggcaaggagaucguggaccugaugugccacgcgacauuuaccaugcggcugcucucuccugucagagugcccaauuauaacaugauuaucauggaugaagcccauuucacggacccuuccagcauugcugcccggggguacaucucuacacgcgugggcaugggagaggcugccgccauuuuuaugaccgcuacacccccuggcagcgucgaagcguucccgcaguccaaugccguuauccaggaugaggaaagagacauccccgagcggucuuggaacagcggguaugaguggauuacagauuuuccuggaaaaaccgugugguucgugcccuccaucaagucuggcaaugacauugcuaacugucuucgcaaaaaugggaagagagucauccagcugagccggaagacauuugauaccgaauaccagaaaacgaagaacaacgacugggacuacgugguuacaaccgauauuuccgagaugggagccaauuucagagccgaccgcgugaucgauccucggagaugccugaaacccgucauucucaaggacggcccggaacgcgugauccuggcugggccuaugcccguuacaguggccagcgcggcucagcggagaggccgcaucggacggaaccacaauaaagagggcgaucaguauauuuacauggggcagccccuuaacaaugacgaggaucaugcccacuggaccgaagccaagaugcugcucgacaacaucaauacgccugagggaauuauccccgcucuguucgaaccugagagagaaaagucugccgcgauugauggcgaguaucgccugagaggggaggcccggaaaaccuuugucgaacucaugcgcagaggagaccuuccgguguggcuguccuacaaggucgcuagcgagggcuuccaauauuccgaucggcgcuggugcuuugacggggaaagaaacaaucaggugcuggaggaaaacauggauguugagaucuggacaaaagagggcgaacggaagaaacucagaccccgcuggcuggacgcccggaccuacucugacccucuugcucugagagaguucaaggaauuugccgcuggacgccggagcguguccggcgaucucauccuggagauugggaaacugccccagcaccucacacagagagcccaaaaugcgcuugacaaccuggugaugcugcauaauucugaacagggaggccgggccuaucgccacgcuauggaggagcucccugauaccaucgaaacacugaugcuucuggcccucauugcuguccugaccgggggaguuacgcuguucuuucucagcggcagaggccuugggaagacauccaucggacugcugugugugauggccagcucugugcuccuguggauggccuccgucgagccccauuggauugcugcgagcaucauccuugaguucuuucugauggugcuccugauuccggagccugaccggcagcgcacaccccaagauaaccaacuggccuacguugugaucggccuccuuuucaugauucugaccgucgcugccaaugagauggggcugcucgaaaccaccaagaaagaccugggaaucggccacguggccgucgggaaccaccaucacgcugccaugcuugauguggaccugcauccugcgucugccuggacacucuacgcuguugccacgaccauuaucacacccaugaugagacacaccauugagaacacaaccgcuaauaucucccugacggccaucgcgaaccaggccgcuauucugaugggacucgauaagggcuggccuaucagcaaaauggacauuggcgugccccuucuggcccuggggugcuauucucaggucaauccgcucacccugacagcugccgugcuuaugcugguugcucauuacgccaucauuggaccuggccuccaagcgaaggccacccgggaagcucagaaacgcacagccgcugggaucaugaagaaccccaccguggauggaaucgucgccauugaccuggaucccgugguguaugacgccaaguuugagaaacagcugggccagaucaugcuccuuauucuguguacgagccaaauccugcucaugagaacaaccugggcgcugugcgaauccauuacacuugcuaccgggccucugaccacacucugggagggaucuccgggcaaguucuggaauacgaccaucgccguuagcauggcuaacaucuuucggggcuccuaccuggccggggccggacuggcuuucagccucaugaaaucccuuggcgggggacgcagaggcacaggggcccagggagagacccugggcgaaaaguggaaacggcagcugaaucagcucucuaagagcgaguucaacacauauaagagauccggcauuauggaagucgaccgcucugaggcgaaagaagggcugaagcggggagagaccacgaaacacgccgugagcagaggcacagcuaaacuucgcugguuuguggagcggaaucuggucaaacccgaagggaagguuaucgaucucggauguggcagagggggaugguccuacuauugcgccggccugaagaaagugaccgaggugaagggcuacaccaaagggggaccuggccacgaagaacccauuccuauggcuacauacggguggaaccuggucaagcuccauucuggaaaagacguguucuuuauucccccugaaaagugugauacccuucugugcgacauuggcgagagcuccccgaaucccacaaucgaggaagggcgcacgcugcggguucucaaaaugguggagccuuggcugagaggaaaccaauucuguauuaagauccuuaaucccuauaugccuagcgucguggaaacccuggagcagaugcagcgcaagcacggcggcaugcucguucggaacccccugucuagaaauuccacacaugagauguacugggugagcugcgggaccggaaacaucgucucugccgugaauaugacaucccgcaugcugcucaaccgguuuaccauggcgcacagaaaaccgacguaugaacgcgauguggaccugggcgccgggaccagacacgucgcuguugagccugaaguggccaaccuugauauuaucggacagcggauugagaauaucaagcaugaacacaaaagcacauggcauuacgacgaggauaaccccuauaagaccugggcuuaccacggcucuuaugaggugaaacccuccgggagcgccuccagcauggucaauggagugguuaagcugcucacaaagccuugggacgugauucccauggucacccaaaucgcuaugacagauaccacgccuuucggccagcagcgcguguuuaaagaaaagguugacacaagaaccccgaaagccaagcggggcaccgcgcaaaucauggaggugacagccaaauggcuguggggguuccuuucuagaaacaagaagccccggauuuguacgcgcgaagaguuuaccagaaaaguccggagcaaugcugccaucggagcuguguucguugacgaaaaccaguggaacuccgccaaggaggccguggaggaugaacgcuuuugggaccugguccauagagagcgggaacuccacaaacagggcaagugcgcgacaugcguguacaacaugauggggaaacgcgagaagaagcugggagaguucggcaaagcuaaggggucuagagccauuugguacauguggcugggcgcccgguuucucgaguucgaggcucugggauucaugaaugaagaucacugguuuagccgcgagaacucccuuucuggcgucgaaggggagggacugcauaaacucggcuauauccugagagacauuagcaagaucccugggggaaauauguacgccgaugacaccgcuggcugggauacacggaucaccgaggacgaucuucagaacgaagcccgcauuacagacaucauggagcccgaacacgcgcugcucgccaaauccauuuucaagcugaccuaucaaaauaaagugguuagagugcagcggccugcuaagaacgggacggucauggaugugaucucucgcagagaccagcggggcagcggacaggugggcaccuacgggcugaauacauuuaccaacauggaggcccaacucauuagacagauggaauccgagggaaucuucagccccucugagcuggaaacaccgaaccuugcugagcgcguucuggauuggcucgaaaaguauggcguggagcggcugaaaagaauggccaucuccggggacgacugugucgugaagccuauugaugaccgcuuugcgaccgcccuuacggcucugaaugauaugggaaaaguucggaaggacaucccccagugggaaccuagcaaaggcuggaacgauuggcagcaagugcccuucugcucucaucacuuucaccagcucauuaugaaggacgggagagagaucgucgugccuugucgcaaucaggaugagcuggucggccgggccagagugucccagggagcuggcuggagccugcgcgaaacagccugccucgggaaguccuacgcucaaauguggcagcugauguauuuccaucggagagaccuucgccuggccgcgaacgccauuuguucugcuguucccguggauuggaucccgaccagccggacaaccugguccauucacgcccaucaccaguggaugacgaccgaggacaugcucagcgucuggaauagaguguggaucgaagagaacccuuggauggaagauaaaacacauaucucuuccuggggagacguucccuaccugggcaagcgggaggaccaauggugcgggagccuuauuggacugaccgccagagcuacaugggccaccaauauccagguggcgauuaaccagguccgccggcucaucggcaaugagaacuaccuggauuauaugacaucuaugaaaagauuuaagaaugaaagcgaccccgagggggcucugugguga

SEQ ID NO: 18590 - RNA, 9879 nt, Artificial Sequence
  derived and/or modified CDS sequence (opt5) from DENV-1__JF937651__SS-prME
agcgugaccaugcugcugaugcugaugcccacagcucuugcuuuccaccugacgaccagaggcggggagccucauaugauccucuccaagcaggaacggggaaaaucucugcuuuuuaagaccagcgccggcgucaauaugugcacccugaucgcgauggaccucggggagcugugugaagauacaaugaccuacaaaugcccgcgcaucacagaggcugaacccgacgauguugacuguuggugcaaugccaccgauacgugggugaccuauggaacauguucccaaaccggcgagcacagacgggacaagcgcucuguggcccuggcuccucaugucgggcucggacuggagacaagaaccgaaacguggaugagcuccgagggcgccuggaaacagauucagcggguggaaacaugggcccuucgccaccccggcuucaccguuaucgcccuguuucucgcgcaugccauugggacaucuaucacccagaagggaaucauuuucauccugcuuaugcuggugaccccuagcauggcuaugagaugcgucggcauugggucccgggauuuuguggagggacucagcggcgccacauggguugacgugguccuggagcacgggucuugugugacgaccauggcuaaggauaaacccacacuggacaucgaacuccugaagaccgaggugacaaacccugccauucuucgcaaacugugcaucgaagcgaagauuuccaauaccacgacagauagcagauguccgacccaaggagaggccacccucgucgaagaacaagacgcuaacuucguuugccggcgcacauuuguggauagaggcuggggcaauggguguggacuguucggcaaagggucucuuauuaccugcgccaaguuuaagugcgugacaaaacuggagggaaagaucguccaguacgaaaaccucaaauauuccgugauuguuacggugcacaccggcgaccagcaucaagucgggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguucauaagcagugguuucuggaucuuccucugcccuggacaagcggggcuuccaccucucaagagacauggaaucgccaggaccuccuggugaccuucaaaaccgcgcacgccaagaagcaggaagucgugguccugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaaguugccgagacccagcacggaaccgugcugguccagaucaaguacgagggcacagacgcgccgugcaaaaucccuuucuccacccaagaugaaaagggggugacacagaacggacggcuuauuacggcuaaucccaucguuaccgacaaagagaagccugugaacauugaagccgagccgcccuuuggcgagagcuauaucgucauuggggccggagaaaaagcucucaagcugucuugguucaagaaaggcagcuccaucgggaagauguuugaggccacagcuagaggcgcccgccggauggcgauccugggagauaccgccugggacuucggcucuauugggggaguguuuacaagcgugggcaaacucauccaucagauuuucgggaccgcuuacggaguucuguuuuccggcgucagcuggacgaugaagaucgggauuggcgugcuucugaccuggcucggacucaauucuagauccacaagccugucuaugaccuguaucgccgugggccuugucacacucuaccugggggugaugguucaggcugauuccggaugcgugauuaacuggaaaggccgcgaacugaagugugggagcggaaucuucgucaccaaugaggugcacacauggaccgaacaauauaaguuucaggccgacuccccuaaacggcucucugcggccaucggcaaggcuugggaggaggggguuugcggcauuagaagcgccacgcgccuggaaaacaucauguggaaacagauuuccaacgagcuuaaucauauccugcucgaaaacgacaugaaguucacaguggucgugggagauguugcuggcauucuggcccaggggaaaaagaugauccggccgcaacccauggaguacaaauauucuuggaaaagcuggggaaaggccaagaucauuggcgcugacgugcagaauaccaccuuuaucauugaugggccuaacacacccgaauguccugacgaucagagagcguggaauaucugggaggucgaggacuacggauucggcauuuuuaccacgaacaucuggcugaaacuucgcgauuccuauacacaggugugcgaccaccggcucaugagcgccgcuaucaaagauucuaaggccgugcacgccgacaugggcuacuggauugaauccgagaaaaaugaaaccuggaagcuggcuagagccagcuucaucgaggucaagacauguauuuggcccaaaucucauacccugugguccaacgggguucucgaaagcgagaugaucauuccgaagaucuauggaggcccuaucucucaacacaauuaccgccccggguacuucacacagaccgcgggaccuuggcaucugggcaaacuugagcuggauuuugaccucugcgaagggacgaccgugguggucgaugagcacugcggaaaccggggccccagccugagaacaaccacagugaccggcaagauuauccacgaaugguguugccgguccuguacgcugccuccccuucgcuucagaggggaggacggaugcugguauggcauggagauucggccgguuaaagaaaaggaggaaaaucucgugaaguccauggucucugcuggguccggagagguggacagcuuuucccugggccugcucuguaucucuauuaugaucgaagagguuaugagaagccgcuggucccggaaaaugcugaugacagggacccuugccguguuccugcuccugauuaugggacagcugacauggaacgaucuuaucagacugugcaucauggucggcgccaaugcuugugaccgcaugggcauggggaccaccuaccucgcccugauggcgacauuuaagaugagaccuauguucgcugugggacuccuguuucggcgccuuacgucuagagagguucugcuccugaccauuggccugagccuuguggccuccgucgaacugcccaacucucucgaggaacugggggauggacucgccaugggcaucaugauucugaaacuucugacagacuuccaaagcuaucagcucugggcuacccugcugucccuuacauuuaucaagaccacguucagccugcauuacgccuggaaaacaauggcuauggugcucucuauugugucccuguuuccccucugccugagcaccaccucucagaagacaaccuggcuuccuguccugcuggggucccucggauguaagccgcugacaauguuccuuaucgccgagaauaaaaucuggggccggcgcagcuggccccugaacgaaggcauuauggcgguugggaucgugucuauucuccuguccagccuccugaagaacgaugugccucuugccggaccccugaucgcuggcgggaugcugauugccugcuaugucaucuccggaagcucugcugaccucagccuggagaaagccgccgagguguccugggaagaggaagcugagcacucuggcgcgagccauaauauccuuguugaagugcaggaugacgggacgaugaagauuaaagaugaggagagagacgauacccugacaauccuccugaaggccacccuccuggcugucuccggaguguacccucuuucuauucccgccacacuguuuguuugguauuucuggcagaagaagaagcagcggagcggcgugcugugggacaccccuagcccucccgaagucgagcgcgccgugcucgaugacggcaucuacagaauuaugcagcgggggcugcuuggacgcucucaggucggcguggggguuuuccaagaaaacguguuucacacgauguggcaugucaccagaggagcugugcugauguaccagggcaaacggcucgagcccagcugggccuccguuaagaaagaccugaucagcuaugggggaggcuggagacuccagggcucuuggaauacaggggaggaagugcaggucauugcgguggagcccggaaagaacccuaaaaaugugcaaaccgcucccggcacauucaagaccccggaaggggagguuggagccaucgcccuggauuuuaagccuggcacauccgggagccccaucgucaaccgcgaaggaaaaauugugggccuuuacggcaaugggguggucacgaccucuggaacauauguguccgcuaucgcccaggcgaaggcuagccaggagggcccucugcccgagauugaagacgagguuuuccggaaaagaaaccugaccaucauggaucuccaccccggguccggaaagacccgccgguaccugccugccauugugagagaagccaucaaacgcaaacuucggacacugauccucgcuccgacgagagucguggccucugagauggcugaagcccugaagggcaugcccauucgcuaucaaaccacagcgguuaaaagcgagcacaccgggaaggagaucguggaccugaugugucaugccacauuuaccaugcggcuccuuuccccugucagagugcccaauuacaacaugauuaucauggaugaagcucacuucacggacccuagcucuauugccgcucggggcuauaucuccacacgcguuggaaugggcgaggccgccgcuaucuuuaugaccgcgacacccccugggagcguggaagccuucccgcagucuaaugcugucauucaggaugaggaaagagacauccccgagcggagcuggaacuccggauacgaguggauuacagauuuuccuggcaaaaccgugugguucgugcccucuaucaagagcgggaaugacauugccaacugccugcgcaaaaauggaaagagagucauccagcugucccggaagacauuugauaccgaauaccagaagacgaagaacaacgacugggacuauguugugacaaccgauauuucugagaugggcgccaauuucagagcugaccgcgugaucgauccucggagaugccucaaacccgucauccugaaggacgggccggaacgcgugauucuugccggcccuaugcccguuacaguggcgagcgcugcccagcggagaggacgcaucggccggaaccauaauaaagagggggaucaguacauuuauaugggacagccccugaacaaugacgaggaucacgcccauuggaccgaagcuaagaugcuccuggacaacaucaauacgccugagggcauuauccccgcccuguucgaaccugagagagaaaaguccgcggccaucgauggggaguaccgccucagaggagaggcucggaaaaccuuugucgaacuuaugcgcagaggcgaccugccgguguggcugagcuauaagguugccucugagggguuccaauacuccgaucggcgcugguguuuugacggcgaaagaaacaaucaggugcucgaggaaaacauggaugucgagauuuggacaaaagagggagaacggaagaaacugagaccccgcuggcuugacgcucggaccuauagcgacccucuggcccucagagaguucaaggaauuugcugccggccgccgguccgugucuggggaucugauccuggagauuggaaaacucccccagcaccuuacacagagagcgcaaaaugcccuggacaaccuggucaugcuccacaauagcgaacagggcgggcgggcuuaccgccaugccauggaggagcugccugauaccaucgaaacacuuaugcugcucgcucugauugccgugcugaccggaggcguuacgcuguucuuucuuuccggcagagggcugggaaagacaucuaucggccugcucugcgugauggccagcuccgugcugcuuuggauggcuagcgucgagccccacuggaucgcggccucuauuauccuggaguucuuucucaugguucugcugauuccggagccugaccggcagcgcacaccccaagauaaccaacucgcuuacguggugaucgggcuucuguucaugauucugaccgucgccgccaaugagaugggacuccuggaaaccaccaagaaagaccuuggcaucgggcauguggcuguuggaaaccaccaccaugccgcgaugcuggauguggaccuccacccugccuccgcuuggacacuguaugccgucgcuacgaccauuaucacacccaugaugaagcauaccaucgagaacacaaccgccaauauuagccugacggcgaucgccaaccaggcugccauucucaugggccuugauaaaggcuggccuaucucuaagauggacauuggggugccccugcuggcucucggauguuacucccaggucaauccgcugacccuuacagccgcugugcugaugcucguugcccacuaugcgaucaucggcccugggcugcaagccaaagcuaccagagaagcccagaagcggacagcugccggaauuaugaagaaccccaccguggauggcaucgucgccauugaccuggaucccgugguuuacgacgcgaaauuugagaagcagcucgggcagaucaugcuucugauucugugcacgagccaaauccuccugaugcgcacaaccugggcucuuugugaaucuaucacacuggccaccggaccucucaccacacugugggagggcagcccgggcaaauucuggaauacgaccauugcuguguccauggccaacaucuuuagagggucuuaucuggccggagcuggccucgccuucagccuuaugaagucccucgggggcgggcggcgcgggacaggagcgcagggcgagacccugggcgaaaaauggaagagacagcucaaucagcugagcaaguccgaguucaacacauacaaacggucugggauuauggaagucgacagaagcgaggccaaggaaggacuuaaacgcggcgagaccacgaagcaugcugugucccgggggacagccaaacugagaugguuuguggagcgcaaucucguuaagcccgaaggaaaggucaucgaucugggcugcgggcggggaggcuggucuuauuacugugcuggccugaaaaaggugaccgaggugaaaggguacaccaagggaggcccugggcacgaagaacccauuccuauggccacauauggauggaaccucgucaaacuucacagcggcaaggacguuuucuuuauucccccugaaaaaugcgauacccugcugugugacaucggggaguccucuccgaaucccacaaucgaggaaggaagaacgcuccgcgugcugaagaugguggagccuuggcuucggggcaaccaauucugcaucaagauucugaaucccuacaugccuagcgucguggaaacccucgagcagaugcagagaaaacauggcgggaugcugguucgcaacccccugucccggaauagcacacacgagauguauugggugucuuguggaaccggcaacaucgucuccgcggugaauaugacaagcagaaugcuccugaaccgcuuuaccauggcccaucggaagccgacguacgaaagagauguugaccuuggggcuggaacccgccacguggccgucgagccugaaguggcuaaccuggauauuaucggccagagaauugagaauaucaaacacgaacauaagucuacauggcacuaugacgaggauaaccccuacaaaaccugggccuaucauggguccuacgaggugaagcccagcggaucugcuuccagcauggucaauggcguugugaagcuccugacaaaaccuugggacgugauccccauggucacccaaauugccaugacagauaccacgccuuucggccagcagcggguguuuaaggaaaaaguugacacacgcaccccgaaggcgaaaagagggaccgcccaaaucauggaggugacagcuaaguggcuuuggggauuccugucccggaacaagaaacccagaauuugcacgcgggaagaguuuaccggcaagguccgcagcaaugccgcuaucggggccguguucguugacgaaaaccaguggaacucugccaaagaggcgguggaggaugaaagauuuugggaccucguccaccgggagcgcgaacugcauaagcagggaaaaugcgcuacauguguguacaacaugaugggcaagagagagaagaaacugggggaguucggcaaggccaaaggaagccgggccauuugguauauguggcucggcgcucgcuuucuggaguucgaggcccuuggguucaugaaugaagaucacugguuuuccagagagaacucucugagcggaguugaaggcgaggggcuccacaagcugggauacauccuucgggacaucuccaaaauuccuggcgggaauauguaugcugaugacaccgccggcugggauacacgcaucaccgaggacgaucugcagaacgaagcgagaauuacagacaucauggagcccgaacaugcccuccuggcuaagucuauuuucaaacugaccuaccaaaauaaggugguccgggugcagcgcccugccaagaacggaacggucauggaugugaucagcagacgggaccagcgcggcuccgggcagguuggaaccuauggccucaauacauuuaccaacauggaggcucaacugaucagacagauggaaucugaggggauuuucagccccuccgagcuugaaacaccgaaccuggccgagcgggugcucgauuggcuggaaaaauacggagucgagagacuuaagcgcauggcgaucagcggcgacgacugcguggugaaaccuauugaugaccgguuugccaccgcucugacggcccucaaugauauggggaagguuagaaaagacaucccccagugggaaccuucuaagggcuggaacgauuggcagcaagugcccuucuguucccaccauuuucaccagcugauuaugaaggacggacgcgagaucgucgugccuugccggaaucaggaugagcugguuggcagagcucgcgugagccagggggccggauggucucuccgggaaacagcuugucugggcaaauccuaugcccaaauguggcagcuuauguacuuccacagacgcgaccugcggcucgcggccaacgcuauuugcagcgccguccccguggauuggaucccgaccuccagaacaaccuggucuauccaugcccaccaucaguggaugacgaccgaggacaugcugagcgucuggaaucgcguguggauugaagagaacccuuggauggaagauaagacacacaucuccagcuggggagacguucccuaccuuggaaaacgggaggaccaaugguguggcucucugauugggcucaccgcuagagccacaugggcgaccaauauccagguggcuauuaaccagguccggagacugaucggcaaugagaacuaucuggauuacaugacauccaugaagcgcuuuaaaaaugaaagcgaccccaagggagcccucugguga

SEQ ID NO: 18591 - RNA, 9879 nt, Artificial Sequence
  derived and/or modified CDS sequence (opt5) from DENV-1__GU131956__SS-prME
agcgugaccaugcugcucaugcugcuucccaccgcccuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaccaucuucauucugcuuaugcuggucacaccuagcauggcuaugcgcugcgugggcaucgggaacagagauuuuguugagggacucuccggcgccacguggguggacgucgugcuggagcacgggagcugugugaccacaauggcuaagaauaaacccacccuggauauugaacuccugaagacagaggucaccaacccugccauccuucggaaacugugcauugaagcgaagaucucuaauacgacaaccgacucccgcuguccgacccagggagaggccacacucguugaagaacaggaugcuaacuucgugugcagacggaccuuuguggaccgcggcuggggcaauggguguggacuguucggcaaagggagccuucugacaugcgccaaguuuaagugcgucacgaaacucgagggaaagauugugcaguacgaaaaccugaaauauucuguuaucgugaccguccacacaggcgaucaacaucagguggggaaugagaccacagaacacggaaccaucgcuacgauuacaccccaggccccuacauccgagauccagcugaccgacuacggcgcccucacacuggacuguagccccagaaccggccuugauuucaacgaaaugguucugcucacgaugaaggagaaaucuuggcuggugcauaagcaaugguuucuugaccugccucuccccuggacauccggggcuagcaccucccaggagacauggaaucggcaggaucugcuggucaccuucaaaaccgcgcacgccaagaagcaagaaguggucgugcucggaucucaggagggcgcuaugcacacagcccugacgggggccaccgaaauucagacaagcggaaccacaaccaucuuugcuggccaucuuaaaugccgccugaagauggacaaacucacgcugaaggggacauccuauguuauguguaccggcagcuucaaacuggagaaggaaguggccgagacccagcacggaacaguccuugugcaaguuaaguacgagggcaccgaugcgccgugcaaaauuccuuucucuacacaggacgaaaagggggugacgcagaacggaagacucaucaccgcuaaucccaucgucacagauaaagagaagccugugaacauugaaaccgagccgcccuuuggcgaguccuauaucgugguuggggccggagaaaaagcccugaagcugagcugguucaagaaaggcucuagcauugggaagauguuugaggcuacagcccggggcgcuagacgcauggccauccucggagacaccgcgugggauuucggcuccauugggggagucuuuacgucugugggcaaacuggugcaucaggucuucgggaccgccuacggagugcuuuuuagcggcguuuccuggacaaugaagaucgggaucggcauucugcucaccuggcugggacugaauagccggucuacaucccuuagcaugaccuguaucgcugugggcauggucacacucuaccugggggugaugguucaagccgacucuggaugcgugauuaacuggaaaggcagagaacugaaguguggguccggaaucuucgucaccaacgaggugcacacguggacagaacaguauaaguuucaggcugauagcccuaaacgccucuccgccgcgauuggcaaggccugggaggaggggguuugcggcauccggucugcuaccagacuggaaaauauuauguggaaacagaucagcaacgagcuuaaucauauccugcucgaaaacgacaugaaguucaccguggucgugggagacgccaauggcauucuggcucaagggaaaaagaugauccgcccgcagcccauggagcacaaauacuccuggaagucuuggggaaaggccaaaauuaucggcgccgauauucagaacacaaccuuuaucaucgacgggccugauacgcccgaauguccugacaaucagcgggcuuggaacauuugggagguggaggauuauggauucggcaucuuuacaaccaauauuuggcugaaacuuagagacagcuacacacaaaugugcgaucaccgccucauguccgcggccaucaaagacagcaaggcuguccaugccgauaugggcuauuggauugaaucugagaaaaacgaaaccuggaagcuggcccgggcuuccuucaucgagguuaagacauguaccuggcccaaaagccacacgcuguggucuaauggggugcucgaauccgagaugaucauuccgaagaucuacggaggcccuauuagccagcauaacuauagacccggguacuucacccagacagccggaccuuggcaccugggcaaacuugagcuggacuuugaucucugcgaagggaccacaguggucguggacgagcacugcggaaaucgcggccccucucugcggaccacgacaguuaccggcaagaucauucaugaaugguguugcagaagcuguacacugccuccccuucgguuccgcggggaggauggaugcugguacggcauggagaucagaccggugaaagaaaaggaggaaaaccucguccgguccauggugagcgcggggucuggagagguugacuccuuuagccugggcauccugugugcuuccauuaugaucgaagaggugaugagaucucgcuggagccggaagaugcucaugaccgggacccuggccgucuuccuucugcucgugaugggacaacugacauggaaugaccugauuagacuuugcaucaugguuggcgccaacgcuuccgaucgcaugggcauggggacgaccuaucuggcccucauggcgacauuuaaaaugagaccuauguucgcugugggacugcucuuucggcgccugaccucuagagagguccuucugcucacaauuggccugagccugguggccuccguggaacuucccaacucucuggaggaacucggggacggacuggccaugggcaucaugaugcucaagcugcuuaccgaguuccagccccaccagcuguggacgacacuccugagccugaccuuuauuaaaaccacacuuucccuggauuacgcuuggaagaccacagccauggcucucagcaucgucucucuguucccucucugucuguccacgaccagccagaaaacaaccuggcuuccgguucugcuggggucuuuuggaugcaagccccucacaauguuccugaucaccgaaaauaagauuuggggccggaaauccuggccucuuaacgagggcaucauggccauugggaucgugagcauucugcucucuucccugcucaagaaugacgugccccuggcgggaccucuuaucgccggcgggaugcugaucgcuuguuaugucauuagcggauccagcgccgaucugucucucgagaaagcugccgaagugagcugggagcaagaagccgagcauuccggcacgucucacaacauccugguugaagugcaggacgaugggaccaugaagauuaaagacgaggagcgcgaugacacacuuaccauccugcucaaggcuacacugcucgcggucagcggaguguaccccauguccauuccugccacccuguuuguuugguauuucuggcagaaaaagaagcagagaucuggcgugcuuugggauacacccagcccgccugaagucgagcgggcugugcuggacgauggcaucuaccgcauccugcaaagagggcuccugggacggucccaggucggcguggggguuuuccaggacggaguguuucauacgauguggcacgucacccgcggcgccgugcuuauguaucaggggaaaagacuggaacccucuugggccagcguuaagaaagaccucauuuccuacggaggcggcuggcgguuccaagggagcuggaauacaggagaggaggugcaggucaucgcuguggaaccuggcaagaaccccaaaaaugugcagaccaccccggggacauuuaagacgccugagggagaaguuggcgccauugcgcuggauuucaagcccgggaccucuggauccccuaucgucaacagagagggcaaaauugugggccucuacgggaauggaguggucacaaccagcggcacauaugugucugcuaucgcccaagccaaggcuucccaggaagggccccugcccgagauugaggacgaaguuuuuaaaaagcgcaaccuuaccaucauggaucugcacccuggaagcggcaaaacgcggagauaccugccggccauggugcgcgaggcgaucaagcggaagcucagaacacugauucuugcucccacccgcgucguggccuccgaaauggccgaggcucugaaagggaugccuauccgguaucagaccacagccguuaagucugaacauaccggcagagagauuguggaccucaugugccacgcuacauucaccaugcgccugcugagccccguccgggugccuaauuacaacaugaucauuauggaugaggcccauuuuacggaccccgcguccaucgccgcuagaggauauaucagcacacggguuggcaugggggaagccgcugccauuuucaugaccgccacaccuccgggaucuguggaggcuuuuccccaguccaaugcggucauccaagaugaagaacgcgacauuccugaaagaagcuggaacucuggcuacgauuggaucaccgacuuccccgggaaaacggugugguuugugccuagcauuaaguccggaaaugauaucgccaacugucuccggaaaaacggcaagcgcgucauccagcuuucuagaaagaccuucgacacagaguaucagaaaaccaagaauaacgacugggauuacguugugacaaccgacauuagcgagaugggggcuaauuuccgggccgauagagugaucgacccccgccggugccugaaaccggucauucugaaggauggcccugaaagagugauccucgccggacccaugcccguuacaguggcuuccgccgcgcagcgccggggcagaauugggcgcaaccaaaauaaagagggagaccaguacgucuauaugggccagccucugaacaaugaugaagaccacgcucauuggaccgaggccaagaugcuucuggauaacaucaauacgcccgaggggauuaucccugcccucuuugaaccggagcgggaaaagucugcugccaucgacggagaguacagacugcgcggcgaagcgagaaaaacauucguggagcugaugcggcgcggggaucuccccguuuggcuuagcuauaagguggccuccgagggcuuucaguacagcgacagacgguggugcuucgauggagaacgcaacaaucaaguccuggaggaaaacauggacguggagauuuggaccaaagaaggcgagagaaagaaacugcggccuagauggcucgacgcucgcaccuauucugauccccuggcccuucgggaguuuaaggaguucgcugccgggagacgcuccgucagcggagaccugauccucgagauuggcaaacugccucagcaccugacacuccgggcucagaaugcccuugauaaccuggugaugcugcacaauuccgaacaagggggaaaggcguacagacaugccauggaggaacuccccgacaccaucgagacacugaugcuucuggcucucauugccguucugacgggcggcgugacccuguuuuuccucucugggaagggacuuggcaaaacaagcaucgggcugcugugugugaccgcuuccucugcccuccuguggauggccagcgucgagccgcacuggaucgcugcguccauuauccuugaauuuuuccugaugguucuccugauuccugagcccgaucggcaacgcacaccucaggacaaccagcuggccuauguggugaucggacuccuuuuuaugauucugaccgucgcugccaacgaaaugggccugcucgagacgaccaagaaagaucuggggaucggacauguggccgcugagaaucaccaacacgccacaaugcuugacguugaucugagacccgcgagcgccuggacccucuacgcuguggccacaaccgucaucacgccuaugaugcggcauacaauugaaaacaccacagcuaauaucucucugaccgccauugcgaaccaggccgcuauccugaugggccucgacaagggcuggcccauuuccaaaauggauaucggggugccgcuucuggcccugggaugcuacagccaggucaauccucucacccugacagcugccgugcuuaugcugguugcucacuaugccauuaucggccccgggcuccaggcgaaggccacgcgcgaggcucaaaagagaaccgccgcuggaaucaugaaaaaccccacaguggacggcauugucgccaucgaucuggacccugugguuuacgacgccaaguucgaaaaacagcuggggcagauuaugcuccuuauccuguguaccucucagauucugcucaugcggacaaccugggcgcugugcgaguccaucacgcuugcuacaggaccgcugaccacccucugggaaggcagccccggcaaguuuuggaauacaaccaucgccgugucuauggcuaacauuuuccgcgggagcuaucuggccggagccggccuggcuuucucccucaugaaaucucuugggggaggcagacgggggacaggagcccaaggcgagacgcugggcgagaaguggaagcgccagcugaaucagcucagcaaauccgaauuuaacaccuacaagagaagcgggaucauggaggucgaucgguccgaagcgaaagagggacugaagagaggcgaaacaaccaaacaugccgugucucgcgggacagcuaaacuucggugguucguggagagaaaucugguuaagccugagggaaaagucauugaccucggcugugggcgcggaggcuggagcuauuacugcgccggccugaagaaagugaccgaagugaagggguauacgaaaggaggccccgggcacgaggaaccuauccccauggcuaccuacggauggaaccuggucaagcuccauuccggcaaagauguguuuuucaugccuccggagaagugugacacacuucugugcgauauuggggaaucuagccccaauccuaccaucgaggagggacggacacugagaguucucaagaugguggaacccuggcugcgcggcaaccaguuuuguaucaaaauucuuaauccuuacaugcccuccgucguggagacccuggaacaaaugcagcggaagcacggcgggaugcucguuagaaacccgcugucucgcaauagcacacacgagauguauuggguguccugcggaaccggcaacaucgucagcgccgugaacaugacgucucggaugcugcucaauagauucacaauggcgcaucgcaaaccuaccuacgagcgggacguugaucugggggccggaaccagacacguggcugucgaacccgagguggccaaccuugacauuaucggccagcgcauugaaaauaucaagaacgagcauaaauccacauggcacuaugaugaagacaaucccuacaagacgugggcuuaucacgggagcuacgaggugaagccuucuggauccgccagcucuauggucaacggcguugugagacugcucaccaaacccugggaugugauuccuauggucacacaaaucgcuaugaccgacacaaccccguuuggccagcagcggguguucaaggagaaaguugacacacgcacccccagagccaagcgggggacgacccagaucauggaagugacagcgaaauggcuguggggauuucuuuccagaaauaagaagccucggauuuguacccgcgaggaguucacaagaaaaguccggagcaacgccgcuaucggcgccguguuuguugaugagaaucaauggaacuccgcuaaggaagccguggaggacgagcgcuucugggaucugguccauagagaacgggagcuccacaaacaggggaagugcgcuaccugcguguauaauaugaugggaaaacgcgaaaagaagcugggcgaguuugggaaagcgaagggcagcagagcuauuugguacauguggcugggagcccgguuccucgaguucgaggcccugggcuuuaugaacgaggaccauugguucucucgcgaaaauagccuuuccgggguugagggagaaggccugcacaaacucggguacauccugagagauauuucuaagauccccggaggcaacauguaugcugacgauacggccgggugggacacacggaucaccgaggaugaccuucagaaugaggcuaaaauuacagaaaucauggagccugaacaugcccugcucgcgaccagcauuuuuaagcugacguaccagaacaaagugguccgcgugcaaagacccgccaagaacggcaccgucauggaugugaucucccggcgcgaccagagaggaucuggccagguugggacauauggacugaauaccuucacaaacauggaggugcagcucauucggcaaauggaaagcgagggcaucuuucugccguccgagcuugaaaccccuaaucuggcugagagaguccucgauuggcuggaaaagcacggggccgagcgccuuaaacggauggcuaucucuggagacgacuguguggugaagcccauugaugacagauucgccacagcgcugaccgcccucaacgauaugggcaaaguucgcaaggacaucccucagugggaacccagcaaaggguggaaugauuggcaacaggugccuuuuugcucccaccauuuccaccaacugauuaugaaggacggccgggagaucgucgugcccuguagaaaccaggaugagcugguuggacgcgcucgggugagccagggcgccggguggucucucagagaaacggcuugccugggaaaguccuacgcccaaauguggcagcuuauguauuuucaucgccgggaccugagacucgcugccaaugcgauuuguagcgccgucccgguggauugggucccuacaucucgcaccaccugguccauccacgcucaccaucaguggaugacaaccgaggacaugcugagcguguggaaccggguuuggaucgaagagaaucccuggauggaagauaaaacacacguguccucuugggaggagguccccuaccuuggcaagagagaagaccaguggugcgggagccugauuggacucacggcccgggccaccugggcuacaaacauccaaguggccauuaaucagguuagacgccugaucggcaacgagaauuaucuggacuacaugaccuccaugaaacgguucaagaacgaaagcgauccugagggggcgcucugguga

SEQ ID NO: 18592 - RNA, 9879 nt, Artificial Sequence
  derived and/or modified CDS sequence (opt5) from DENV-1__GU131958__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacgccaaguucgaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguuuuggaauaccacaauugccguuucuauggcuaacaucuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggauuauggagguggaucgguccgaagcgaaagagggacugaagagaggcgaaaccacaaaacaugccgucucucgcgggaccgcuaagcuucggugguucguggagagaaaucuggugaagccugagggaaaaguuaucgaccucggcugugggcgcggaggcuggagcuauuacugcgccggccugaagaaagucacagaagugaagggguauaccaaaggaggccccgggcacgaggaaccuauccccauggcuacguacggauggaaccuggugaagcuccauuccggcaaagaugucuuuuucaugccuccggagaagugugacacccuucugugcgauauuggggaaucuagccccaauccuacaaucgaggagggacggacccugagaguucucaagaugguggaacccuggcugcgcggcaaccaguuuuguauuaaaauccuuaauccuuacaugcccuccguggucgagacacuggaacaaaugcagcggaagcacggcgggaugcucgugagaaacccgcugucucgcaauagcacccacgagauguauuggguuuccugcggaacaggcaacauugugagcgccgucaacaugaccucucggaugcugcucaauagauucacgauggcgcaucgcaaaccuacauuugagcgggacguggaucugggggccggaaccagacacguugcuguggaacccgaggucgccaaccuugacaucauuggccagcgcaucgaaaauaucaagaacgagcauaaauccaccuggcacuacgaugaagacaaucccuauaagacaugggcuuaccacgggagcuaugaggugaagccuucuggauccgccagcucuauggugaacggcgucguuagacugcucacgaaacccugggaugugauuccuauggugacccaaaucgcuaugacagacaccacaccguucggccagcagcgggucuuuaaggagaaaguggacacccgcacacccagagccaagcgggggaccacgcagauuauggaaguuaccgcgaaauggcuguggggauuccuuuccagaaauaagaagccucggaucuguacacgcgaggaauuuaccagaaaagugcggagcaacgccgcuauuggcgccgucuucguggaugagaaucaauggaacuccgcuaaggaagccguugaggacgagcgcuuuugggaucuggugcauagagaacgggagcuccacaaacaggggaagugcgccacaugcgucuacaauaugaugggaaaacgcgaaaagaagcugggcgaguucgggaaagcgaagggcagcagagcuaucugguauauguggcugggagcccgguuccucgaauuugaggcccugggcuucaugaacgaggaccauugguuuucucgcgaaaauagccuuuccgggguggagggagaaggccugcacaaacucggguacauccugagagauauuucuaagauccccggaggcaacauguacgcugacgauaccgccgggugggacacgcggauuacagaggaugaccuucagaaugaggcuaaaaucaccgauauuauggaaccugagcaugcccugcucgcgacaagcaucuucaagcugaccuaucagaacaaaguugugcgcguccaaagacccgccaagaacggcacggugauggacgucaucucccggcgcgaucagagaggaucuggccagguggggaccuacggacugaauacauuuaccaacauggaaguucagcucauucggcaaauggagagcgaaggcaucuuccugccguccgagcuugagacaccuaaucuggcugaaagagugcucgacuggcuggagaagcacggggccgaacgccuuaaacggauggcuauuucuggagacgauugugucgugaagcccaucgacgauagauuugccaccgcgcugacagcccucaacgacaugggcaaagugcgcaaggauauuccucagugggagcccagcaaaggguggaaugacuggcagcagguuccuuucugcucccaccauuuucaccaacugaucaugaaggauggccgggaaaucgugguccccuguagaaaccaggacgagcuggugggacgcgcucggguuagccagggcgccggguggucucucagagagaccgcuugccugggaaaguccuaugcccaaauguggcagcuuauguacuuccaucgccgggaucugagacucgcugccaaugcgauuuguagcgccgugccggucgacugggugccuacgucucgcacaaccugguccauccacgcucaccaucaguggaugaccacagaagauaugcugagcgucuggaaccggguguggauugaggaaaaucccuggauggaggacaaaacccacguuuccucuugggaagaggugcccuaucuuggcaagagagaggaccaguggugcgggagccugaucggacucacagcccgggccacgugggcuaccaacauucaagucgccaucaaucaggugagacgccugauuggcaacgaaaauuaccuggauuauaugacauccaugaaacgguuuaagaacgagagcgacccugaaggggcgcucugguga

SEQ ID NO: 18593 - RNA, 9879 nt, Artificial Sequence
  derived and/or modified CDS sequence (opt5) from DENV-1__GQ868499__SS-prME
agcgugacaaugcugcucaugcugcuucccacagcucuggcuuuccaccucacgaccagaggaggggaaccucauaugaucgucuccaagcaggaacggggaaaaucucugcuuuuuaagacaagcgccggaguuaauaugugcacccugauugcgauggaccucggggagcugugugaagauacaaugaccuacaaaugcccccagaucacagaggcugaacccgacgauguggacuguuggugcaaugccaccgauacgugggugaccuauggaacauguucccagaccggagggcaccgcagagagaagcggucugucgcccuggcuccucaugugggacucggccuggagacacgcaccgaaacguggaugagcuccgagggcgccuggaaacagauucagagaguugaaacaugggcccuucggcaccccggguucaccgugaucgcccuguuucucgcgcaugccauuggaacaucuaucacccaaaagggcaucauuuucauccugcuuaugcuggucaccccuagcauggcuaugcgcugcguggggauuggaaacagagacuuuguugagggccucuccggggccacauggguggaugucgugcuggagcacggaagcugugugacgaccauggcuaagaauaaacccacacuggacaucgaacuccugaagaccgaggucacaaacccugccguucuucggaaacugugcauugaagcgaagaucucuaauaccacgacagauucccgcuguccgacccagggcgaggccacccucguggaagaacaagacgcuaacuucgugugcagacggacauuugucgaucgcggcugggggaauggauguggccuguucgggaaaggaagccuucugaccugcgccaaguuuaagugcgugacaaaacucgagggcaagauuguucaguacgaaaaccugaaauauucugugaucgucacggugcacaccggggaccaacaucagguuggaaaugagacaaccgaacacggcacaaucgcuaccauuacgccccaggccccuaccuccgagauccagcugacagauuacggcgcccucacccuggacuguagccccagaacagggcuugacuucaacgaaauggugcugcucaccaugaaggagaaaucuuggcugguccauaagcaaugguuucuugaucugccucuccccuggacguccggagcuagcacaucccaggagaccuggaaucggcaggaccugcuggugacauucaaaaccgcgcacgccaagaagcaagaagucgugguucucggcucucaggagggggcuaugcacaccgcccugacaggagccacggaaauucagaccagcggcacaaccacaaucuuugcugggcaucuuaaaugccgccugaagauggauaaacucacccugaagggcacguccuaugugauguguacaggcagcuucaaacuggagaaggaagucgccgagacccagcacggcaccgugcuuguucaagugaaguacgaggggacagacgcgccgugcaaaauuccuuucucuacccaggaugaaaagggagucacacagaacggcagacucaucacggcuaaucccaucgugaccgacaaagagaagccugugaacauugaaacagagccgcccuuuggggaguccuauaucguugucggagccggcgaaaaagcccugaagcugagcugguucaagaaagggucuagcauuggcaagauguuugaggcuaccgcccggggagcuagacgcauggccauccucggcgauacagcgugggacuucggguccauuggaggcguguuuaccucuguggggaaacugguccaucagguguucggaacggccuacggcguucuuuuuagcgggguguccuggaccaugaagaucggcaucggcauucugcucacauggcugggccugaauagccggucuaccucccuuagcaugacauguaucgcugucgggauggugacccucuaccugggaguuauggugcaagccgauucuggcugcgucauuaacuggaaagggagagaacugaaguguggauccggcaucuucgugacaaacgagguucacaccuggacggaacaguauaaguuucaggcugacagcccuaaacgccucuccgccgcgauugggaaggccugggaggagggcgugugcggaauccggucugcuacaagacuggaaaauauuauguggaaacagaucagcaacgagcuuaaucauauccugcucgaaaacgauaugaaguucaccgucguggugggcgacgccaaugggauucuggcucaaggcaagaagaugauccgcccgcagcccauggagcacaaauacuccuggaagucuuggggcaaggccaaaauuaucggggccgacauucagaacaccacauuuaucaucgauggaccugacacccccgaauguccugauaaucagcgggcuuggaacauuugggaggucgaggacuauggcuucggcaucuuuacgacaaauauuuggcugaaacuuagagauagcuacacccaaaugugcgaccaccgccucauguccgcggccaucaaagauagcaaggcuguucaugccgacaugggguauuggauugaaucugagaaaaacgaaacauggaagcuggcccgggcuuccuucaucgaggugaagaccuguacauggcccaaaagccacacccuguggucuaauggagugcucgaauccgagaugaucauuccgaagaucuacggcgggccuauuagccagcauaacuauagacccggauacuucacgcagaccgccggcccuuggcaccuggggaaacuugagcuggauuuugaccucugcgaaggaacaaccgucgugguugaugagcacugcggcaaucgcggccccucucugcggacaaccacggugacagggaagaucauucaugaaugguguugcagaagcuguacccugccuccccuucgguuccgcggagaggacggcugcugguacgggauggagaucagaccggucaaagaaaaggaggaaaaccucgugcgguccaugguuagcgcgggaucuggcgagguggauuccuuuagccuggggauccugugugcuuccauuaugaucgaagaggucaugagaucucgcuggagccggaagaugcucaugacaggaacccuggccguguuccuucugcucauuaugggccaacugaccuggaaagaccugaucagacuuugcauuaugguuggcgccaaugcuuccgaccgcauggggaugggaacaacguaucuggcccucauggcgaccuuuaagaugagaccuauguucgcugugggccugcucuuucggcgccugacaucuagagagguccuucugcucaccaucgggcugagccugguggccucccuugaacugcccaacucucucgaggaacugggagauggccucgccauggggauuaugaugcugaaacuucugacagaguuccagccccaccagcucuggaccacgcugcugagccuuacauuuaucaagaccacccugucccucgacuacgcuuggaaaacaaccgccauggcucugagcaucgugucucucuucccucugugucuuuccacaacgagccagaagaccacauggcugccgguccugcucggaucuuuuggcugcaagccccugaccauguuccuuauuacagaaaacaaaaucuggggccggaaguccuggccucugaaugaggggauuauggccaucggaauuguuagcauccuccugucuucccuccugaaaaacgaugugccccuugcgggcccucugaucgccgggggaaugcugauugcuuguuaugugaucagcggcuccagcgccgaccucucucuggagaaggucgcugaagugagcugggagcaagaagccgagcauuccgggaccucucacaauauucuuguugaagugcaggaugacggaacgaugaaaaucaaggaugaggagcgcgacgauacccugacaauucuccugaaagccacccuccuggcugucagcggcguguaccccauguccaucccugcgacacuuuuuguuugguauuucuggcagaagaagaaacagagaucuggcgugcugugggacacccccagcccgccugaagucgagcgggccgugcuggaugacgggaucuaccgcauucuccaaagaggacugcuuggccggucccaggucggggugggaguuuuccaggauggcguguuucauacaauguggcacgucacgcgcggggcugugcugauguaucagggaaagagacucgaacccucuugggccagcguuaaaaaggaccugaucuccuacggcggcggguggcgguuccaaggaagcuggaacaccggcgaggaggugcaggucauugccguggaaccugggaaaaaucccaagaacgugcagacaaccccgggaaccuuuaagacaccugagggcgaaguuggggcuaucgcccucgacuucaaacccggaacgucuggcuccccuauugucaauagagagggcaagaucguggggcuguacggaaacggcguggucaccacaagcgggaccuaugugucugcgauugcucaagccaaagccucccaggaaggaccccuucccgagaucgaggaugaaguuuuuaagaaacgcaaucugacaaucauggaccugcacccuggcagcgggaagacccggagauaccucccggcuauugugcgcgaggccaucaagcggaaacugagaacgcuuauucuggcgcccacacgcgucguggcuuccgaaauggccgaggcccucaagggcaugccuauccgguaucagaccaccgcuguuaaaucugaacauacaggaagagagauuguggaucugaugugccacgccaccuucacaaugcgccugcucagccccguccgggugccuaacuacaauaugaucaucauggacgaggcucauuuuaccgaucccgccuccauugcggccagaggcuauaucagcacgcggguugggaugggagaagcugccgcuauuuucaugacagccaccccuccgggcucuguggaggccuuuccccaguccaacgcugucauccaagacgaagaaagagauauuccugaaagaagcuggaacucuggguacgacuggaucacagauuuccccggaaagaccgugugguuugugccuagcaucaaauccggcaacgacauugcgaauugucuucggaagaacgggaagcgcgucauccagcugucuagaaaaacguucgauaccgaguaucagaagaccaaaaauaaugacugggacuacguugugaccacagauauuagcgagaugggcgccaacuuccgggcugacagagugaucgauccccgccggugccugaagccggucauucucaaagacggaccugaaagagugauccuggccggccccaugcccguuaccguggccuccgcugcccagcgccgggggagaauuggacgcaaucaaaacaaggagggcgaucaguacgucuauauggggcagccucuuaauaacgacgaagaucacgcgcauuggacagaggcuaagaugcugcucgacaauaucaacacccccgagggaaucauuccugcccuguuugaaccggagcgggaaaaaucugccgcuaucgauggcgaguacagacugcgcggggaagccagaaagacguucguggagcucaugcggcgcggcgaccuucccguuuggcugagcuauaaaguggcguccgagggauuucaguacagcgauagacgguggugcuucgacggcgaacgcaauaaccaaguccuggaggaaaauauggauguggagauuuggacaaaggaaggggagcgcaaaaagcuccggccuagauggcuggacgcccgcaccuauucugacccccuugcucugcgggaguuuaaagaguucgccgcuggaagacgcuccgucagcggcgaucucauccuggagauugggaagcugccucagcaccucacccuucgggcccagaacgcucuggacaaucuggugaugcuccacaacuccgaacagggaggcaaggccuacagacaugcgauggaggaacugcccgauacaaucgagacccuuaugcugcucgcccugaucgcuguucugacaggcggggugacgcucuuuuuccuuucuggaaaaggccuggggaagaccagcauuggacugcucugugugacagccuccucugcucugcuuuggauggccagcgucgagccgcacuggaucgccgcuuccauuauccuggaauuuuuccucaugguucugcugauuccugagcccgaccggcaacgcaccccucaggauaaucagcucgcguauguggugaucggccuucuguuuaugauccugacagucgccgcuaacgaaauggggcuccuggagaccacgaaaaaggaccuuggaauuggccauguggccgccgagaaccaccaacacgcuaccaugcuggauguugaccucagacccgccagcgcguggacacuguacgccguggcuaccacagucaucaccccuaugaugcggcauacgauugaaaauacaaccgccaacaucucucugacagcuauugccaaucaggcggccauccucaugggccuugauaaaggguggcccauuuccaagauggacaucggagugccgcugcuggcucucggcugcuacagccaggucaacccucugacccuuaccgccgcugugcugaugcucguugcccacuaugcuaucauugggcccggacugcaggccaaggcgacacgcgaggcccagaaaagaacggcugccggcaucaugaagaaucccaccguggaugggauugucgcuaucgaccuggauccugugguuuacgacgccaaauucgaaaagcagcucggacagauuaugcuucugauccuguguacaucucagauccuccugaugcggaccacaugggcccuuugcgaguccauuacccuggcgacgggcccgcucacaacccugugggaaggcagccccgggaaauuuuggaacaccacaaucgcugugucuauggccaauauuuuccgcggaagcuaucuggcuggcgccgggcucgccuucucccuuaugaagucucugggaggcgggagacggggaaccggcgcucaaggcgagacacugggggagaaguggaaacgccagcucaaccagcugagcaaguccgaauuuaauacguacaaaagaagcggaaucauggaggucgaccgguccgaagccaaggagggccuuaaaagaggggaaaccacaaagcaugcggugucucgcggaaccgccaagcugcggugguucguggagagaaaccucguuaaaccugagggcaaggucauugaucugggguguggacgcggcggcuggagcuauuacugcgcugggcugaaaaaggugacagaagugaaaggauauaccaagggcgggcccggacacgaggaaccuauccccauggccacguacggcuggaaucucgucaaacuucauuccgggaaggacguguuuuucaugccuccggagaagugugauacccugcugugcgacaucggagaaucuagccccaacccuacaauugaggagggccggacccucagaguucugaaaaugguggaacccuggcuucgcggcaaucaguuuuguaucaagauucugaacccuuacaugcccuccgucguggagacacucgaacaaaugcagcggaaacacgggggaaugcugguuagaaauccgcugucucgcaacagcacccacgagauguauuggguguccugcggcacagggaauaucgucagcgcugugaacaugaccucucggaugcuccugaacagauucacgauggcccaucgcaagccuacauacgagcgggauguugaccuuggagcgggcaccagacacguggccgucgaacccgagguggcuaaucuggauauuaucgggcagcgcauugaaaacaucaaaaaugagcauaaguccaccuggcacuaugacgaagauaaccccuacaagacaugggccuaucacggaagcuacgaggugaaaccuucuggcuccgcuagcucuauggucaauggcguugugagacuccugacgaagcccugggacgugaucccuauggucacccaaauugccaugacagauaccacaccguuugggcagcagcggguguucaaagagaagguugacacccgcacacccagagcuaaacggggaaccacgcagaucauggaagugaccgccaaguggcuuuggggcuuucuguccagaaacaagaaaccucggauuuguacacgcgaggaguucaccagaaagguccggagcaaugcggccaucggggcuguguuuguugacgagaaccaauggaacuccgccaaagaagcuguggaggaugagcgcuucugggaccucguccauagagaacgggagcugcacaagcagggaaaaugcgccacaugcguguauaacaugaugggcaagcgcgaaaagaaacugggggaguuuggcaaggccaaaggaagcagagcgauuugguacauguggcucggcgcucgguuccuggaguucgaggcccuuggguuuaugaaugaggaucauugguucucucgcgaaaacagccuguccggaguugagggcgaagggcuccacaagcugggauacauccuuagagacaucucuaaaauucccggcgggaauauguaugccgaugacaccgcuggcugggauacgcggaucacagaggacgaucugcagaacgaggccaagauuaccgacaucauggaaccugagcaugcucuccuggccacaagcauuuuuaaacugaccuaccagaauaaggugguccgcgugcaaagacccgcgaagaacggaacggucauggaugugaucucccggcgcgaccagagaggcucugggcagguuggaaccuauggccucaacacauucaccaauauggaagugcagcugauccggcaaauggagagcgaagggauuuuucuuccguccgagcuggagacaccuaaccucgccgaaagaguccuggauuggcuugagaaacacggagcugaacgccugaagcggauggccaucucuggcgacgacuguguggugaaacccauugaugacagauucgcuaccgcccucacagcgcugaaugauauggggaagguucgcaaagacaucccucagugggagcccagcaagggcuggaacgauuggcaacaggugccuuuuugcucccaccauuuccaccaacugauuaugaaggacggacgggaaaucgucgugcccuguagaaaucaggaugagcucguuggccgcgcccgggugagccagggggcuggauggucucugagagagaccgccugccuuggcaaauccuacgcucaaauguggcagcugauguauuuucaucgccgggaccucagacuggccgcuaacgccaucuguagcgcggucccgguggauugggucccuacgucucgcacaaccugguccauucacgcccaccaucaguggaugaccacagaagacaugcuuagcguguggaaucggguuuggaucgaggaaaaccccuggauggaggauaagacccacguguccucuugggaagagguccccuaccuggggaaaagagaggaccaguggugcggaagccucauuggccugacagcucgggccacgugggccaccaauauccaaguggcuauuaaccagguuagacgccugaucgggaaugaaaacuaucucgacuacaugacauccaugaagcgguucaaaaaugagagcgauccugaaggcgcccugugguga

SEQ ID NO: 18594 - RNA, 9879 nt, Artificial Sequence
  derived and/or modified CDS sequence (opt5) from DENV-1__GQ868500__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucgugaugggacaacugaccuggaaugaccugaucagacuuugcauuaugguuggcgccaacgcuuccgaucgcaugggcauggggacaacguaucuggcccucauggcgaccuuuaaaaugagaccuauguucgcugugggacugcucuuucggcgccugacaucuagagagguccuucugcucaccaucggccugagccugguggccuccguggaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgcuuggaagacaaccgccauggcucucagcaucgucucucuguucccucucugucuguccacaacgagccagaaaaccacauggcuuccgguucugcuggggucuuuuggaugcaagccccucaccauguuccugauuacagaaaauaagaucuggggccggaaauccuggccucuuaacgagggcauuauggccaucgggauugugagcauccugcucucuucccugcucaagaaugacgugccccuggcgggaccucuuaucgccggcgggaugcugauugcuuguuaugucaucagcggauccagcgccgaucugucucucgagaaagcugccgaagugagcugggagcaagaagccgagcauuccggcaccucucacaacauucugguugaagugcaggacgaugggacgaugaagaucaaagacgaggagcgcgaugacacccuuacaauucugcucaaggcuacccugcucgcggucagcggaguguaccccauguccaucccugccacacuguuuguuugguauuucuggcagaaaaagaagcagagaucuggcgugcuuugggauacccccagcccgccugaagucgagcgggcugugcuggacgauggcaucuaccgcauucugcaaagagggcuccugggacggucccaggucggcguggggguuuuccaggacggaguguuucauacaauguggcacgucacgcgcggcgccgugcuuauguaucaggggaaaagacuggaacccucuugggccagcguuaagaaagaccucaucuccuacggaggcggcuggcgguuccaagggagcuggaauaccggagaggaggugcaggucauugcuguggaaccuggcaagaaccccaaaaaugugcagacaaccccggggaccuuuaagacaccugagggagaaguuggcgccaucgcgcuggauuucaagcccgggacgucuggauccccuauugucaacagagagggcaaaaucgugggccucuacgggaauggaguggucaccacaagcggcaccuaugugucugcuauugcccaagccaaggcuucccaggaagggccccugcccgagaucgaggacgaaguuuuuaaaaagcgcaaccuuacaaucauggaucugcacccuggaagcggcaaaacccggagauaccugccggccauggugcgcgaggcgauuaagcggaagcucagaacgcugauccuugcucccacacgcgucguggccuccgaaauggccgaggcucugaaagggaugccuauucgguaucagaccaccgccguuaagucugaacauacaggcagagagaucguggaccucaugugccacgcuaccuucacaaugcgccugcugagccccguccgggugccuaauuacaacaugauuaucauggaugaggcccauuuuaccgaccccgcguccaucgccgcuagaggauauauuagcacgcggguuggcaugggggaagccgcugccaucuucaugacagccaccccuccgggaucuguggaggcuuuuccccaguccaaugcggucauucaagaugaagagcgcgacaucccugaaagaagcuggaacucuggcuacgauuggauuacagacuuccccgggaaaaccgugugguuugugccuagcaucaaguccggaaaugauaucgccaacugucuccggaaaaacggcaagcgcgucauucagcuuucuagaaagacguucgacaccgaguaucagaaaacaaagaauaacgacugggauuacguugugaccacagacaucagcgagaugggggcuaauuuccgggccgauagagugauugacccccgccggugccugaaaccggucauccugaaggauggcccugaaagagugauucucgccggacccaugcccguuaccguggcuuccgccgcgcagcgccggggcagaaucgggcgcaaccaaaauaaagagggagaccaguacgucuauaugggccagccucugaacaaugaugaagaccacgcucauuggacagaggccaagaugcuucuggauaacauuaauacccccgaggggaucaucccugcccucuuugaaccggagcgggaaaagucugcugccauugacggagaguacagacugcgcggcgaagcgagaaaaacguucguggagcugaugcggcgcggggaucuccccguuuggcuuagcuauaagguggccuccgagggcuuucaguacagcgacagacgguggugcuucgauggagaacgcaacaaucaaguccuggaggaaaacauggacguggagaucuggacaaaagaaggcgagagaaagaaacugcggccuagauggcucgacgcucgcaccuauucugauccccuggcccuucgggaguuuaaggaauucgcugccgggagacgcuccgucagcggagaccugauucucgagaucggcaaacugccucagcaccugacccuccgggcucagaaugcccuugauaaccuggugaugcugcacaauuccgaacaggggggaaaggcguacagacaugccauggaggaacuccccgacacaauugagacccugaugcuucuggcucucaucgccguucugacaggcggcgugacgcuguuuuuccucucugggaagggacuuggcaaaaccagcaucgggcugcugugugugacagcuuccucugcccuccuguggauggccagcgucgagccgcacuggauugcugcguccaucauucuugaauuuuuccugaugguucuccugaucccugagcccgaucggcaacgcaccccucaggacaaccagcuggccuauguggugauuggacuccuuuuugucauccugacaguggcugccaacgaaaugggccugcucgagaccacgaagaaagaucuggggaucggacauguugccgcugagaaucaccaacacgccaccaugcuugacguggaucugagacccgcgagcgccuggacacucuacgcugucgccaccacagugauuaccccuaugaugcggcauacgaucgaaaacacaaccgcuaauauuucucugacagccaucgcgaaccaggccgcuauucugaugggccucgacaagggcuggcccaucuccaaaauggauauuggggucccgcuucuggcccugggaugcuacagccaggugaauccucucacccugaccgcugccguucuuaugcugguggcucacuaugccaucaucggccccgggcuccaggcgaaggccacacgcgaggcucaaaagagaacggccgcuggaauuaugaaaaaccccaccgucgacggcaucguggccauugaucuggacccuguuguguacgacgccaaguucgaaaaacagcuggggcagaucaugcuccuuauucuguguacaucucagauccugcucaugcggaccacaugggcgcugugcgaguccaucacccuugcuacgggaccgcugacaacccucugggaaggcagccccggcaaguuuuggaauaccacaauugccgucucuauggcuaacaucuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggauuauggagguggaucgguccgaagcgaaagagggacugaagagaggcgaaaccacaaaacaugccgugucucgcgggaccgcuaagcuucggugguucguugagagaaaucuggucaagccugagggaaaagugaucgaccucggcugugggcgcggaggcuggagcuauuacugcgccggccugaagaaagugacagaagucaagggguauaccaaaggaggccccgggcacgaggaaccuauucccauggcuacguacggauggaaccugguuaagcuccauuccggcaaagauguguuuuucaugccuccggagaagugugacacccuucugugcgauaucggggaaucuagccccaauccuacaaucgaggagggacggacccugagagugcucaagauggucgaacccuggcugcgcggcaaccaguuuuguauuaaaauccuuaauccuuacaugcccuccgugguugagacacuggaacaaaugcagcggaagcacggcgggaugcucgugagaaacccgcugucucgcaauagcacccacgagauguauugggucuccugcggaacaggcaacauugugagcgccguuaacaugaccucucggaugcugcucaauagauucacgauggcgcaucgcaaaccuacauacgagcgggacguggaucugggggccggaaccagacacgucgcuguggaacccgagguggccaaccuugacaucauuggccagcgcaucgaaaauauuaagaacgagcauaaauccaccuggcacuaugaugaagacaaucccuacaagacaugggcuuaucacgggagcuacgaggucaagccuucuggauccgccagcucuaugguuaacggcguggugagacugcucacgaaacccugggaugucaucccuauggugaagcaaaucgcuaugaccgacacaaccccguuuggccagcagcggguuuucaaagagaagguggacacacgcacccccagagccaaacgggggacaacccagauuauggaagucacggcgaaguggcuguggggauuucuuuccagaaauaagaaaccucggaucuguacccgcgaggaauucacaagaaaggugcggagcaacgccgcuauuggcgccguuuuugugggggagaaucaauggaacuccgcuaaagaagccgucgaggaugagcgcgugugggaccugguucauagagaacgggagcuccacaagcagggaaaaugcgccaccugcguguauaauaugaugggcaagcgcgaaaagaaacugggggaguucggcaaggcgaaaggaagcagagcuaucugguacauguggcugggcgcccgguuucucgaauucgaggcccugggguucaugaacgaggaucauugguuuucucgcgaaaauagccuuuccggagucgagggcgaagggcugcacaagcucggauacauucugagagacaucucuaaaauccccggcgggaacauguaugcugaugacacagccggcugggauacccggauuacggaggacgaucuucagaaugaggcuaagaucacagaaauuauggagccugaacaugcccugcucgcgaccagcaucuucaaacugacauaccagaacaaggugguccgcgugcaaagacccgccaagaacggaaccguuauggacgugauuucccggcgcgaucagagaggcucugggcaggucggaacguauggccugaauaccuuuacaaacauggaggugcagcucauccggcaaauggaaagcgaggggaucuuccugccguccgagcuugaaaccccuaaucuggcugagagagugcucgacuggcuggaaaaacacggagccgagcgccuuaagcggauggcuauuucuggcgaugacuguguugugaaacccaucgacgauagauuugccacagcgcugaccgcccucaacgacauggggaagguccgcaaagauauuccucagugggaacccagcaagggcuggaaugacuggcagcaggugccuuucugcucccaccauuuucaccaacugaucaugaaggauggacgggagauuguugugcccuguagaaaccaggacgagcuggucggccgcgcucgggugagccagggggccggauggucucucagagaaacagcuugccugggcaaauccuacgcccaaauguggcagcuuauguauuuccaucgccgggaucugagacucgcugccaaugcgaucuguagcgccgucccgguggacuggguuccuaccucucgcacgacaugguccauccacgcucaccaucaguggaugaccaccgaggauaugcugagcguguggaaccgggucuggauugaagagaaucccuggauggaagacaagacacacguguccucuugggaggagguucccuaccuugggaaaagagaagaucaguggugcggaagccugaucggccucaccgcccgggccacaugggcuacgaacauucaaguggccaucaaucaggucagacgccugauugggaacgagaauuaucuggacuacaugaccuccaugaagcgguuuaaaaacgaaagcgacccugagggcgcgcucugguga

SEQ ID NO: 18595 - RNA, 9879 nt, Artificial Sequence
  derived and/or modified CDS sequence (opt5) from DENV-1__GU131961__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucagacuggagaaagaaguggccgagacccagcacggaaccguccuugugcaaguuaaguacgagggcacagaugcgccgugcaagaucccuuucucuacccaggacgaaaaaggggugacacagaacggacggcucaucacggcuaaucccauugucaccgauaaggagaaaccugugaacaucgaaacagagccccccuuuggcgaguccuauauugugguuggggccggagaaaaggcccugaaacugagcugguucaagaagggcucuagcaucgggaaaauguuugaggcuaccgccagaggcgcucgccggauggccauucucggagacacagcgugggauuucggcuccaucgggggagucuuuaccucugugggcaagcuggugcaucaggucuucgggacggccuacggagugcuuuuuagcggcguuuccuggaccaugaaaaucgggauuggcauccugcucacauggcugggacugaauagcagaucuaccucccuuagcaugacauguauugcugugggcauggucacccucuaccugggggugaugguucaagccgacucuggaugcgugaucaacuggaagggccgcgaacugaaauguggguccggaauuuucgucacaaacgaggugcacaccuggacggaacaguauaaguuucaggcugauagcccuaagcggcucuccgccgcgaucggcaaagccugggaggaggggguuugcggcauuagaucugcuacacgccuggaaaauaucauguggaagcagaucagcaacgagcuuaaucauauucugcucgaaaacgacaugaaauucaccguggucgugggagacgccaauggcauccuggcucaagggaagaaaaugauucggccgcagcccauggagcacaaguacuccuggaaaucuuggggaaaggccaagaucauuggcgccgauauccagaacaccacauuuaucauugacgggccugauacccccgaauguccugacaaucagagagcuuggaacaucugggagguggaggauuauggauucggcauuuuuacgacaaauaucuggcugaaacuucgcgacagcuacacccaaaugugcgaucaccggcucauguccgcggccauuaaggacagcaaagcuguccaugccgauaugggcuauuggaucgaaucugagaagaacgaaacauggaaacuggccagagcuuccuucaucgagguuaagaccuguacauggcccaagagccacacccuguggucuaauggggugcucgaauccgagaugauuaucccgaaaauuuacggaggcccuaucagccagcauaacuaucgccccggguacuucacgcagaccgccggaccuuggcaccugggcaagcuugagcuggacuuugaucucugcgaagggacaaccguggucguggacgagcacugcggaaaucggggccccucucugagaacaaccacgguuacaggcaaaauuauccaugaaugguguugccggagcuguacccugccuccccuucgcuucagaggggaggauggaugcugguacggcauggagauccggccggugaaggaaaaagaggaaaaccucgucagauccauggugagcgcggggucuggagagguugacuccuuuagccugggcauucugugugcuuccaucaugauugaagaggugaugcgcucucgguggagcagaaagaugcucaugacagggacccuggccgucuuccuucugcucaucaugggacaacugaccuggaaugaccugauucgccuuugcaucauggugggcgccaacgcuuccgauagaaugggcauggggacaacguaucuggcccucauggcgaccuuuaagaugcggccuauguucgcuguuggacugcucuuucgcagacugacaucucgggaggugcuucugcucaccauuggccugagccuggucgccuccguggaacuucccaacucucuggaggaacucggggacggacuggccaugggcaucaugaugcucaaacugcuuacagaguuccagccccaccagcuguggaccacgcuccugagccugacauuuaucaagaccacccuuucccuggauuacgcuuggaaaacaaccgccauggcucucagcauugugucucuguucccucucugucuguccacaacgagccagaagaccacauggcuuccgguccugcuggggucuuuuggaugcaaaccccucaccauguuccugaucacagaaaauaagauuuggggccgcaaguccuggccucuuaacgagggcaucauggccauugggaucguuagcauccugcucucuucccugcucaaaaaugacgugccccuggcgggaccucuuauugccggcgggaugcugaucgcuuguuaugugauuagcggauccagcgccgaucugucucucgagaaggcugccgaagucagcugggagcaagaagccgagcauuccggcaccucucacaacauccugguggaaguucaggacgaugggacgaugaaaauuaaggacgaggagagagaugacacccuuacaauccugcucaaagcuacccugcucgcggugagcggagucuaccccauguccaucccugccacacuguuugugugguauuucuggcagaagaaaaagcagcggucuggcguucuuugggauacccccagcccgccugaaguggagcgcgcuguccuggacgauggcauuuacagaauccugcaacgggggcuccugggacgcucccaggugggcgucgggguguuccaggacggaguuuuucauacaauguggcacgugacgagaggcgccguccuuauguaucaggggaagcggcuggaacccucuugggccagcgugaaaaaggaccucauuuccuacggaggcggcuggagauuccaagggagcuggaauaccggagaggagguucaggugaucgcugucgaaccuggcaaaaaccccaagaaugugcagacaaccccggggaccuuuaaaacaccugagggagaagugggcgccauugcgcuggauuucaagcccgggacgucuggauccccuaucguuaaccgcgagggcaagauugucggccucuacgggaauggaguggugaccacaagcggcaccuaugucucugcuaucgcccaagccaaagcuucccaggaagggccccugcccgagaucgaggacgaaguguuuaagaaacggaaccuuacaauuauggaucugcacccuggaagcggcaagaccagacgcuaccugccggccaucguucgggaggcgauuaaaagaaagcuccgcacgcugauccuugcucccacacggguggucgccuccgaaauggccgaggcucugaaggggaugccuauuagauaucagaccaccgccgugaaaucugaacauacaggccgcgagaucguugaccucaugugccacgcuaccuucacaaugcggcugcugagccccgugagagucccuaauuacaacaugaucauuauggaugaggcccauuuuaccgaccccgcguccaucgccgcucggggauauauuagcacgcgcgugggcaugggggaagccgcugccaucuucaugacagccaccccuccgggaucuguugaggcuuuuccccaguccaaugcggugauucaagaugaagagagagacaucccugaacggagcuggaacucuggcuacgauuggaucacagacuuccccgggaagaccgucugguuugugccuagcauuaaauccggaaaugauaucgccaacugucuccgcaagaacggcaaaagagugauucagcuuucucggaagacguucgacaccgaguaucagaagacaaaaaauaacgacugggauuacgucguuaccacagacaucagcgagaugggggcuaauuucagagccgaucgcgugauugacccccggagaugccugaagccggugauccugaaagauggcccugaacgcgucauucucgccggacccaugcccgugaccguugcuuccgccgcgcagcggagaggccgcaucgggcggaaccaaaauaaggagggagaccaguacguguauaugggccagccucugaacaaugaugaagaccacgcucauuggacagaggccaaaaugcuucuggauaacaucaauacccccgaggggauuaucccugcccucuuugaaccggagagagaaaagucugcugccauugacggagaguaccgccugagaggcgaagcgcggaagacguucgucgagcugaugcgcagaggggaucuccccguguggcuuagcuauaaaguugccuccgagggcuuucaguacagcgaccggcgcuggugcuucgauggagaaagaaacaaucaagugcuggaggaaaacauggacgucgagaucuggacaaaggaaggcgagcggaaaaagcugagaccucgcuggcucgacgcucggaccuauucugauccccuggcccuuagagaguuuaaagaauucgcugccgggcgccgguccgugagcggagaccugauucucgagaucggcaagcugccucagcaccugacccucagagcucagaaugcccuugauaaccuggucaugcugcacaauuccgaacaggggggaaaagcguaccggcaugccauggaggaacuccccgacacaaucgagacccugaugcuucuggcucucauugccgugcugacaggcggcguuacgcuguuuuuccucucugggaagggacuuggcaagaccagcaucgggcugcugugugugacagcuuccucugcccuccuguggauggccagcguggagccgcacuggauugcugcguccaucauucuugaauuuuuccugaugguccuccugaucccugagcccgaucgccaaagaaccccucaggacaaccagcuggccuauguugugaucggacuccuuuuuaugauucugacaguggcugccaacgaaaugggccugcucgagaccacgaaaaaggaucuggggaucggacaugucgccgcugagaaucaccaacacgccaccaugcuugacguggaucugcggcccgcgagcgccuggacacucuacgcuguugccaccacagugauuaccccuaugaugcgccauacgaucgaaaacacaaccgcuaauauuucucugacagccaucgcgaaccaggccgcuauucugaugggccucgacaaaggcuggcccaucuccaagauggauaucggggucccgcuucuggcccugggaugcuacagccaggugaauccucucacccugaccgcugccguccuuaugcugguggcucacuaugccauuaucggccccgggcuccaggcgaaagccacaagagaggcucaaaagcggacggccgcuggaauuaugaagaaccccaccguugacggcaucguggccauugaucuggacccugucguguacgacgccaaauucgaaaagcagcuggggcagaucaugcuccuuauccuguguacaucucagauucugcucaugcgcaccacaugggcgcugugcgaguccaucacccuugcuacgggaccgcugacaacccucugggaaggcagccccggcaaauuuuggaauaccacaauugccguuucuauggcuaacaucuucagagggagcuaucuggccggagccggccuggcuuucucccucaugaagucucuugggggaggccggcgcgggaccggagcccaaggcgagacacugggcgagaaauggaagagacagcugaaucagcucagcaaguccgaauuuaacacguacaaacggagcgggauuauggagguggauagauccgaagcgaaggagggacugaaacgcggcgaaaccacaaagcaugccgucucucgggggaccgcuaaacuuagaugguucguggagcgcaaucuggugaagccugagggaaagguuaucgaccucggcugugggcggggaggcuggagcuauuacugcgccggccugaaaaaggucacagaagugaaaggguauaccaagggaggccccgggcacgaggaaccuauccccauggcuacguacggauggaaccuggugaaacuccauuccggcaaggaugucuuuuucaugccuccggagaaaugugacacccuucugugcgauauuggggaaucuagccccaauccuacaaucgaggagggaagaacccugcgcguucucaagaugguggaacccuggcugcggggcaaccaguuuuguauuaagauccuuaauccuuacaugcccuccguggucgagacacuggaacaaaugcagagaaaacacggcgggaugcucgugcgcaacccgcugucucggaauagcacccacgagauguauuggguuuccugcggaacaggcaacauugugagcgccgucaacaugaccucuagaaugcugcucaaucgcuucacgauggcgcaucggaagccuacauuugagagagacguggaucugggggccggaacccgccacguugcuguggaacccgaggucgccaaccuugacaucauuggccagagaaucgaaaauaucaaaaacgagcauaaguccaccuggcacuacgaugaagacaaucccuauaaaacaugggcuuaccacgggagcuaugaggugaagccuucuggauccgccagcucuauggugaacggcgucguucggcugcucacgaagcccugggaugugauuccuauggugacccaaaucgcuaugacagacaccacaccguucggccagcagcgcgucuuuaaagagaagguggacaccagaacaccccgggccaaaagagggaccacgcagauuauggaaguuaccgcgaaguggcuguggggauuccuuucccggaauaaaaagccucgcaucuguacaagagaggaauuuacccggaaggugcgcagcaacgccgcuauuggcgccgucuucguggaugagaaucaauggaacuccgcuaaagaagccguugaggacgagagauuuugggaucuggugcaucgggaacgcgagcuccacaagcaggggaaaugcgccacaugcgucuacaauaugaugggaaagagagaaaaaaagcugggcgaguucgggaaggcgaaaggcagccgggcuaucugguauauguggcugggagcccgcuuccucgaauuugaggcccugggcuucaugaacgaggaccauugguuuucuagagaaaauagccuuuccgggguggagggagaaggccugcacaagcucggguacauccugcgggauauuucuaaaauccccggaggcaacauguacgcugacgauaccgccgggugggacacgcgcauuacagaggaugaccuucagaaugaggcuaagaucaccgauauuauggaaccugagcaugcccugcucgcgacaagcaucuucaaacugaccuaucagaacaagguugugagaguccaacggcccgccaaaaacggcacggugauggacgucaucucccgcagagaucagcggggaucuggccagguggggaccuacggacugaauacauuuaccaacauggaaguucagcucauuagacaaauggagagcgaaggcaucuuccugccguccgagcuugagacaccuaaucuggcugaacgcgugcucgacuggcuggagaagcacggggccgaacggcuuaagagaauggcuauuucuggagacgauugugucgugaaacccaucgacgaucgcuuugccaccgcgcugacagcccucaacgacaugggcaaggugcggaaagauauuccucagugggagcccagcaagggguggaaugacuggcagcagguuccuuucugcucccaccauuuucaccaacugaucaugaaagauggcagagaaaucgugguccccugucgcaaccaggacgagcuggugggacgggcuagaguuagccagggcgccggguggucucuccgcgagaccgcuugccugggaaaguccuaugcccaaauguggcagcuuauguacuuccaucggagagaucugcgccucgcugccaaugcgauuuguagcgccgugccggucgacugggugccuacgucucggacaaccugguccauccacgcucaccaucaguggaugaccacagaagauaugcugagcgucuggaacagaguguggauugaggaaaaucccuggauggaggacaagacccacguuuccucuugggaagaggugcccuaucuuggcaaacgggaggaccaguggugcgggagccugaucggacucacagccagagccacgugggcuaccaacauucaagucgccaucaaucaggugcgccggcugauuggcaacgaaaauuaccuggauuauaugacauccaugaagagauuuaaaaacgagagcgacccugaagggguucucugguga

SEQ ID NO: 18596 - RNA, 9870 nt, Artificial Sequence
  derived and/or modified CDS sequence (opt5) from DENV-1__GU131962__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucuguguguguccaucaugauugaagaggucaugagaucucgcuggagccggaagaugcucaugacagggacccuggcuguguuccuucugcucguuaugggacaacugaccuggaaugaccugaucagacuuugcauuauggugggcgccaacgccuccgaucgcaugggcauggggacaacguaucuggcucucauggccaccuuuaaaaugagaccuauguucgcggucggacugcucuuucggcgccugacaucuagagaggugcuucugcucaccaucggccugagccugguggcuuccgucgaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgccuggaagacaaccgcuauggcccucagcaucguuucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggcuaucgggauugugagcauccugcucucuucccugcucaagaaugacgucccccuggccggaccucuuaucgcgggcgggaugcugauugccuguuaugugaucagcggauccagcgcugaucugucucucgagaaagccgcugaaguuagcugggagcaagaagccgagcauuccggcaccucucacaacauucugguggaaguccaggacgaugggacgaugaagaucaaagacgaggagcgcgaugacacccuuacaauucugcucaaggccacccugcucgcugugagcggaguuuaccccauguccaucccugcgacacuguuugugugguauuucuggcagaaaaagaagcagagaucuggcguccuuugggauacccccagcccgccugaaguggagcgggccguccuggacgauggcaucuaccgcauucugcaaagagggcuccugggacggucccaggugggcguugggguguuccaggacggagucuuucauacaauguggcacgugacgcgcggcgcuguucuuauguaucaggggaaaagacuggaacccucuugggccagcgugaagaaagaccucaucuccuacggaggcggcuggcgguuccaagggagcuggaauaccggagaggagguccaggugauugccguggaaccuggcaagaaccccaaaaauguucagacaaccccggggaccuuuaagacaccugagggagaagucggcgcuaucgcccuggauuucaagcccgggacgucuggauccccuauugugaacagagagggcaaaaucgugggccucuacgggaauggagucgugaccacaagcggcaccuauguuucugcgauugcucaagccaaggccucccaggaagggccccugcccgagaucgaggacgaaguguuuaaaaagcgcaaccuuacaaucauggaucugcacccuggaagcggcaaaacccggagauaccugccggcuauuguccgcgaggccaucaagcggaagcucagaacgcugauucuugcgcccacacgcgugguugcuuccgaaauggccgaggcccugaaagggaugccuauccgguaucagaccaccgcugugaagucugaacauacaggcagagagauugucgaccucaugugccacgccaccuucacaaugcgccugcugagccccgugcggguuccuaauuacaacaugaucaucauggaugaggcucauuuuaccgaccccgccuccauugcggccagaggauauaucagcacgcgggugggcaugggggaagcugccgcuauuuucaugacagccaccccuccgggaucugucgaggccuuuccccaguccaaugcugugauccaagaugaagagcgcgacauuccugaaagaagcuggaacucuggcuacgauuggaucacagacuuccccgggaaaaccgugugguuugucccuagcaucaaguccggaaaugauauugcgaacugucuccggaaaaacggcaagcgcguuauccagcuuucuagaaagacguucgacaccgaguaucagaaaacaaagaauaacgacugggauuacguggugaccacagacauuagcgagaugggggccaauuuccgggcugauagagucaucgacccccgccggugccugaaaccggugauucugaaggauggcccugaaagaguuauccucgccggacccaugcccgugaccgucgccuccgcugcccagcgccggggcagaauugggcgcaaccaaaauaaagagggagaccaguacguguauaugggccagccucugaacaaugaugaagaccacgcgcauuggacagaggcuaagaugcuucuggauaacaucaauacccccgaggggaucauuccugcccucuuugaaccggagcgggaaaagucugccgcuaucgacggagaguacagacugcgcggcgaagccagaaaaacguucguugagcugaugcggcgcggggaucuccccguguggcuuagcuauaaggucgcguccgagggcuuucaguacagcgacagacgguggugcuucgauggagaacgcaacaaucaagugcuggaggaaaacauggacgucgagauuuggacaaaagaaggcgagagaaagaaacugcggccuagauggcucgacgcccgcaccuauucugauccccuggcucuucgggaguuuaaggaauucgccgcugggagacgcuccgugagcggagaccugauccucgagauuggcaaacugccucagcaccugacccuccgggcccagaaugcucuugauaaccugguuaugcugcacaauuccgaacaggggggaaaggccuacagacaugcgauggaggaacuccccgacacaaucgagacccugaugcuucuggcccucaucgcugugcugacaggcggcgugacgcuguuuuuccucucugggaagggacuuggcaaaaccagcauugggcugcugugugucacagccuccucugcucuccuguggauggccagcguugagccgcacuggaucgccgcuuccauuauccuugaauuuuuccugauggugcuccugauuccugagcccgaucggcaacgcaccccucaggacaaccagcuggcguauguggucaucggacuccuuuuuaugauccugacaguggccgcuaacgaaaugggccugcucgagaccacgaagaaagaucuggggauuggacauguugccgccgagaaucaccaacacgcuaccaugcuugacguggaucugagacccgccagcgcguggacacucuacgccgucgcuaccacagugaucaccccuaugaugcggcauacgauugaaaacacaaccgccaauaucucucugacagcuauugccaaccaggcggccauccugaugggccucgacaagggcuggcccauuuccaaaauggauaucggggucccgcuucuggcucugggaugcuacagccaggugaauccucucacccugaccgccgcuguucuuaugcugguggcccacuaugcuaucauuggccccgggcuccaggccaaggcgacacgcgaggcccaaaagagaacggcugccggaaucaugaaaaaccccaccgucgacggcauuguggcuaucgaucuggacccuguuguguacgacgccaaguucgaaaaacagcuggggcagauuaugcuccuuauccuguguacaucucagauccugcucaugcggaccacaugggcccugugcgaguccauuacccuugcgacgggaccgcugacaacccucugggaaggcagccccggcaaguuuuggaauaccacaaucgcugucucuauggccaacauuuuccgcgggagcuaucuggcuggagccggccuggccuucucccucaugaaaucucuugggggaggcagacgggggaccggagcucaaggcgagacacugggcgagaaguggaagcgccagcugaaucagcucagcaaauccgaauuuaacacguacaagagaagcgggaucauggagguggaucgguccgaagccaaagagggacugaagagaggcgaaaccacaaaacaugcggugucucgcgggaccgccaagcuucggugguucguugagagaaaucuggucaagccugagggaaaagugauugaccucggcugugggcgcggaggcuggagcuauuacugcgcuggccugaagaaagugacagaauaugccuccgcugggcuggccaucaucgucccccucccucuugauaccuacggacggaacagacugaagauucacucuggcaaagacguuuuuuucaugcccccugagaagggggauacgcugcucugugacaucggagaaagcuccccgaaucccaccauugaggaaggccgcacacugcgggugcuuaaaaugguggagccuuggcugagagggaaccaguuuugcaucaagauucucaaucccuacaugccuucugucguggaggcgcuggaacaaaugcagcgcaagcauggaggcaugcugguucggaacccccucagcagaaauuccacccacgagauguauugggugagcuguggcacagggaacaucgucucugccgugaacaugaccucccgcaugcugcuuaaucgguucacaauggcucacagaaaaccgaccuacgaacgcgauguugaccugggagccggcacgagacauguggcugucgagccugagguggccaaccucgauauuaucgggcagcggaucgaaaauauuaagaacgagcacaaaagcacauggcauuaugacgaagauaaucccuacaagaccugggcuuaucacggaucuuacgaggugaaacccuccggcagcgccucuuccauggucaacgggguugugcgccugcuuaccaagccuugggacgugauccccauggucacacaaauugcgaugacggacaccacaccuuuuggacagcagagaguguucaaggaaaaaguugauacccggacaccgagagccaagcggggcaccacacagaucauggaggugaccgcuaaauggcuguggggcuuucucagccgcaauaagaaacccagaauuugcacgcgggaggaauucacccgcaaggucagauccaacgccgcuaucggggccguguuuguugacgagaaucaauggaacagcgccaaggaagcgguggaggaugaacgguucugggaccugguccaccgcgagagagagcugcauaaacagggaaagugugcuacaugcguguauaauaugaugggcaaacgggaaaagaaacucggggaguuuggaaaggccaagggcucucgcgccaucugguacauguggcugggggcuagauuccuugaauucgaggcccugggcuuuaugaacgaagaucacugguucagccgggagaauucccucucuggaguugagggcgaagggcugcauaaacuuggauacauucugcgcgacaucagcaagauuccuggcgggaacauguaugcugaugacaccgccggaugggauacaagaaucaccgaggacgaucuccagaaugaagcgaaaauuacggagaucauggagcccgaacacgcccugcuggcuacauccaucuuuaagcucaccuaccagaacaaagugguccgggugcaacgcccugccaagaacggcacagucauggacgugauuucuagacgggaucagagagggagcggccagguuggaaccuauggccugaauacguucaccaacauggaggugcagcuuauccgccaaauggaauccgaggggauuuuucugcccucugaacucgagacaccgaaucuggcugagcggguccuugacuggcuggaaaaacauggagccgagagacucaagcgcauggcgaucagcggcgacgauugcguggugaagccuauugacgaucgguucgccaccgcucugacagcccugaacgacauggggaaaguuagaaaggauaucccccagugggaaccuuccaaaggauggaaugacuggcagcaggugcccuuuuguagccaccacuuccaucaacucaucaugaaggauggccgcgagauugucgugccuugccggaaccaggacgaacugguugggagagcucgcgugucucagggcgccggauggucccuucgggagaccgcuugucugggcaaaagcuacgcccaaauguggcagcucauguauuuucacagacgcgaucugcggcuugcggccaaugcuaucugcucugccguccccguggacugggucccgacauccagaaccacguggagcauucaugcccaccaccaguggaugacaaccgaggauaugcuguccguguggaaccggguuuggaucgaagagaauccuuggauggaagacaagacccaugugucuagcugggaggaaguccccuaccucgggaagagagaggaccagugguguggaucccugauuggccugacagcucgcgccaccugggcgacaaacauccaaguggcuauuaaucagguucggagacucaucgggaacgagaauuaucuggauuacaugacgagcaugaaacgcuucaagaacgaaucugaccccgagggagcccuuugguga

SEQ ID NO: 18597 - RNA, 9879 nt, Artificial Sequence
  derived and/or modified CDS sequence (opt5) from DENV-1__GU131963__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgccuuuuuccuggcgcaugccauugggacaucuaucacccaaaagggaaucauuuuuauccuccugaugcuugucaccccuagcauggcuaugcgcugcgugggcauugggaacagagauuucguugagggacuguccggcgccacauggguggacgucgugcucgagcacgggagcugugugacgaccauggcuaagaauaaacccacacuggauaucgaacugcucaagaccgaggucacaaacccugccauucugcggaaacuuugcaucgaagcgaagauuucuaauaccacgacagacucccgcuguccgacccagggagaggccacccugguugaagagcaggaugcuaacuuugugugcagacggacauucguggaccgcggcuggggcaauggguguggacucuuuggcaaagggagccugcuuaccugcgccaaguucaagugcgucacaaaacuggagggaaagaucgugcaguacgaaaaccucaaauauucuguuaucgugacgguccacaccggcgaucaacaucagguggggaaugagacaaccgaacacggaacaauugcuaccaucacgccccaggccccuaccuccgagauucagcugacagacuacggcgcccugacccucgacuguagccccagaacaggccuggauuuuaacgaaaugguucuucugaccaugaaggagaaaucuuggcucgugcauaagcaaugguuccuggaccuuccucugcccuggacguccggggcuagcacaucccaggagaccuggaaucggcaggaucuccuggucacauuuaaaaccgcgcacgccaagaagcaagaaguggucgugcugggaucucaggagggcgcuaugcacaccgcccucacaggggccacggaaauccagaccagcggaacaaccacaauuuucgcuggccaucugaaaugccgccuuaagauggacaaacugacccucaaggggacguccuauguuauguguacaggcagcuucaaacuggagaaggaaguggccgagacccagcacggaaccguccuggugcaaguuaaguacgagggcacagaugcgccgugcaaaaucccuuuuucuacccaggacgaaaagggggugacacagaacggaagacuuaucacggcuaaucccauugucaccgauaaagagaagccugugaacaucgaaacagagccccccuucggcgaguccuauauugugguuggggccggagaaaaagcccucaagcugagcugguuuaagaaaggcucuagcaucgggaagauguucgaggcuaccgcccggggcgcuagacgcauggccauucugggagacacagcgugggauuuuggcuccaucgggggagucuucaccucugugggcaaacucgugcaucaggucuuugggacggccuacggagugcuguucagcggcguuuccuggaccaugaagaucgggauuggcauccuucugacauggcucggacugaauagccggucuaccucccugagcaugacauguauugcugugggcauggucacccuuuaccucggggugaugguucaagccgacucuggaugcgugaucaacuggaaaggcagagaacugaaguguggguccggaauuuuugucacaaacgaggugcacaccuggacggaacaguauaaguuccaggcugauagcccuaaacgccuguccgccgcgaucggcaaggccugggaggaggggguuugcggcauucggucugcuacaagacucgaaaauaucauguggaaacagaucagcaacgagcugaaucauauucuucuggaaaacgacaugaaguuuaccguggucgugggagacgccaauggcauccucgcucaagggaaaaagaugauucgcccgcagcccauggagcacaaauacuccuggaagucuuggggaaaggccaaaaucauuggcgccgauauccagaacaccacauucaucauugacgggccugauacccccgaauguccugacaaucagcgggcuuggaacaucugggagguggaggauuauggauuuggcauuuucacgacaaauaucuggcugaagcugagagacagcuacacccaaaugugcgaucaccgccuuauguccgcggccauuaaagacagcaaggcuguccaugccgauaugggcuauuggaucgaaucugagaaaaacgaaacauggaagcucgcccgggcuuccuucaucgagguuaagaccuguacauggcccaaaagccacacccuguggucuaauggggugcuggaauccgagaugauuaucccgaagauuuacggaggcccuaucagccagcauaacuauagacccggguacuuuacgcagaccgccggaccuuggcaccucggcaaacuggagcuugacuucgaucugugcgaagggacaaccguggucguggacgagcacugcggaaaucgcggccccucucuccggacaaccacgguuacaggcaagauuauccaugaaugguguugcagaagcuguacccugccuccccugcgguuucgcggggaggauggaugcugguacggcauggagaucagaccggugaaagaaaaggaggaaaaccuuguccgguccauggugagcgcggggucuggagagguugacuccuucagccucggcauucuguguguguccaucaugauugaagaggucaugagaucucgcuggagccggaagaugcugaugacagggacccucgcuguguuucugcuucugguuaugggacaacucaccuggaaugaccugaucagacugugcauuauggugggcgccaacgccuccgaucgcaugggcauggggacaacguaucuugcucugauggccaccuucaaaaugagaccuauguuugcggucggacuccuguuccggcgccucacaucuagagaggugcugcuucugaccaucggccucagccugguggcuuccgucgaacugcccaacucucuugaggaacugggggacggacucgccaugggcauuaugaugcugaagcuccugacagaguuucagccccaccagcuuuggaccacgcugcucagccugacauucaucaaaaccacccugucccuugauuacgccuggaagacaaccgcuauggcccugagcaucguuucucucuuuccucugugucucuccacaacgagccagaaaaccacauggcugccggugcuucuggggucuuucggaugcaagccccugaccauguuucucauuacagaaaauaagaucuggggccggaaauccuggccucugaacgagggcauuauggcuaucgggauugugagcauccuucugucuucccuccugaagaaugacgucccccucgccggaccucugaucgcgggcgggaugcuuauugccuguuaugugaucagcggauccagcgcugaucugucucuggagaaagccgcugaaguuagcugggagcaagaagccgagcauuccggcaccucucacaacauucucguggaaguccaggacgaugggacgaugaagaucaaagacgaggagcgcgaugacacccugacaauucuucugaaggccacccuccuggcugugagcggaguuuaccccauguccaucccugcgacacucuucgugugguauuucuggcagaaaaagaagcagagaucuggcguccugugggauacccccagcccgccugaaguggagcgggccguccuugacgauggcaucuaccgcauucugcaaagagggcugcucggacggucccaggugggcguugggguguuucaggacggagucuuccauacaauguggcacgugacgcgcggcgcuguucugauguaucaggggaaaagacuugaacccucuugggccagcgugaagaaagaccugaucuccuacggaggcggcuggcgguuucaagggagcuggaauaccggagaggagguccaggugauugccguggaaccuggcaagaaccccaaaaauguucagacaaccccggggaccuucaagacaccugagggagaagucggcgcuaucgcccucgauuuuaagcccgggacgucuggauccccuauugugaacagagagggcaaaaucgugggccuguacgggaauggagucgugaccacaagcggcaccuauguuucugcgauugcucaagccaaggccucccaggaagggccccuccccgagaucgaggacgaaguguucaaaaagcgcaaccugacaaucauggaucuucacccuggaagcggcaaaacccggagauaccugccggcuauuguccgcgaggccaucaagcggaagcugagaacgcucauucuggcgcccacacgcgugguugcuuccgaaauggccgaggcccuuaaagggaugccuauccgguaucagaccaccgcugugaagucugaacauacaggcagagagauugucgaccugaugugccacgccaccuuuacaaugcgccuccugagccccgugcggguuccuaauuacaacaugaucaucauggaugaggcucauuucaccgaccccgccuccauugcggccagaggauauaucagcacgcgggugggcaugggggaagcugccgcuauuuuuaugacagccaccccuccgggaucugucgaggccuucccccaguccaaugcugugauccaagaugaagagcgcgacauuccugaaagaagcuggaacucuggcuacgauuggaucacagacuuucccgggaaaaccgugugguucgucccuagcaucaaguccggaaaugauauugcgaacugucugcggaaaaacggcaagcgcguuauccagcucucuagaaagacguucgacaccgaguaucagaaaacaaagaauaacgacugggauuacguggugaccacagacauuagcgagaugggggccaauuuucgggcugauagagucaucgacccccgccggugccuuaaaccggugauucugaaggauggcccugaaagaguuauccuggccggacccaugcccgugaccgucgccuccgcugcccagcgccggggcagaauugggcgcaaccaaaauaaagagggagaccaguacguguauaugggccagccucucaacaaugaugaagaccacgcgcauuggacagaggcuaagaugcugcuugauaacaucaauacccccgaggggaucauuccugcccuguucgaaccggagcgggaaaagucugccgcuaucgacggagaguacagacuccgcggcgaagccagaaaaacguuuguugagcugaugcggcgcggggaucugcccguguggcucagcuauaaggucgcguccgagggcuuccaguacagcgacagacgguggugcuuugauggagaacgcaacaaucaagugcuugaggaaaacauggacgucgagauuuggacaaaagaaggcgagagaaagaaacugcggccuagauggcuggacgcccgcaccuauucugauccccucgcucugcgggaguucaaggaauuugccgcugggagacgcuccgugagcggagaccuuauccuggagauuggcaaacucccucagcaccugacccugcgggcccagaaugcucucgauaaccuuguuaugcugcacaauuccgaacaggggggaaaggccuacagacaugcgauggaggaacugcccgacacaaucgagacccucaugcugcuugcccugaucgcugugcucacaggcggcgugacgcuguucuuucugucugggaagggacucggcaaaaccagcauugggcuucugugugucacagccuccucugcucugcucuggauggccagcguugagccgcacuggaucgccgcuuccauuauccuggaauucuuucuuauggugcugcucauuccugagcccgaucggcaacgcaccccucaggacaaccagcuggcguauguggucaucggacugcucuucaugauccuuacaguggccgcuaacgaaaugggccugcuggagaccacgaagaaagaucucgggauuggacauguugccgccgagaaucaccaacacgcuaccaugcuggacguggaucuuagacccgccagcgcguggacacuguacgccgucgcuaccacagugaucaccccuaugaugcggcauacgauugaaaacacaaccgccaauaucucucucacagcuauugccaaccaggcggccauccugaugggccuggacaagggcuggcccauuuccaaaauggauaucggggucccgcuccuugcucugggaugcuacagccaggugaauccucugacccucaccgccgcuguucugaugcuuguggcccacuaugcuaucauuggccccgggcugcaggccaaggcgacacgcgaggcccaaaagagaacggcugccggaaucaugaaaaaccccaccgucgacggcauuguggcuaucgaucucgacccuguuguguacgacgccaaguuugaaaaacagcuggggcagauuaugcugcucauccuuuguacaucucagauccugcugaugcggaccacaugggcccucugcgaguccauuacccuggcgacgggaccgcuuacaacccugugggaaggcagccccggcaaguucuggaauaccacaaucgcugucucuauggccaacauuuuccgcgggagcuaucucgcuggagccggccuggccuuuucccugaugaaaucucucgggggaggcagacgggggaccggagcucaaggcgagacacuuggcgagaaguggaagcgccagcugaaucagcugagcaaauccgaauucaacacguacaagagaagcgggaucauggagguggaucgguccgaagccaaagagggacucaagagaggcgaaaccacaaaacaugcggugucucgcgggaccgccaagcugcggugguuuguugagagaaaucuugucaagccugagggaaaagugauugaccugggcugugggcgcggaggcuggagcuauuacugcgcuggccucaagaaagugacagaagucaagggguauaccaaaggaggccccgggcacgaggaaccuauccccauggccacguacggauggaaccugguuaagcugcauuccggcaaagauguguucuuuaugccuccggagaagugugacacccuccuuugcgauaucggggaaucuagccccaauccuacaauugaggagggacggacccugagagugcugaagauggucgaacccuggcuccgcggcaaccaguucuguaucaaaauucugaauccuuacaugcccuccgugguugaggcucuugaacaaaugcagcggaagcacggcgggaugcuggugagaaacccgcucucucgcaauagcacacacgagauguauugggucuccugcggaaccggcaacaucgugagcgccguuaacaugacaucucggaugcugcugaauagauuuaccauggcgcaucgcaaaccuacguacgagcgggacguggaucucggggccggaacaagacacgucgcuguggaacccgagguggccaaccuggacauuaucggccagcgcauugaaaauaucaagaacgagcauaaauccaccuggcacuaugaugaagacaaucccuacaagaccugggcuuaucacgggagcuacgaggucaagccuucuggauccgccagcucuaugguuaacggcguggugagacuucugacaaaacccugggaugucaucccuauggugacgcaaauugcuaugaccgacacaaccccguucggccagcagcggguuuuuaaggagaaaguggacacacgcacccccagagccaagcgggggacaacccagaucauggaagucacggcgaaauggcucuggggauuccuguccagaaauaagaagccucggauuuguacccgcgaggaauuuacaagaaaagugcggagcaacgccgcuaucggcgccguuuucguggaugagaaucaauggaacuccgcuaaggaagccgucgaggacgagcgcuuuugggaucuugugcauagagaacgggagcugcacaaacaggggaagugcgccaccugcguuuauaauaugaugggaaaacgcgaaaagaagcucggcgaguucgggaaagcgaagggcagcagagcuauuugguacauguggcugggagcccgguuccuggaauuugaggcccucggcuucaugaacgaggaccauugguuuucucgcgaaaauagccuguccgggguggagggagaaggccuucacaaacugggguacauccucagagauaucucuaagauucccggaggcaacauguaugcugacgauacagccgggugggacacccggaucacggaggaugaccugcagaaugaggcuaaaauuacagaaaucauggagccugaacaugcccuucuggcgaccagcauuuucaagcucacauaccagaacaaagucgugcgcguccaaagacccgccaagaacggcaccgugauggauguuaucucccggcgcgaccagagaggaucuggccagguggggacguauggacugaauaccuuuacaaacauggagguccagcugauccggcaaauggaaagcgagggcauuuuccucccguccgagcuggaaaccccuaaucuugcugagagagugcuggauuggcucgaaaagcacggggccgagcgccugaaacggauggcuaucucuggagacgacugugugguuaagcccauugaugacagauuugccacagcgcuuaccgcccugaacgauaugggcaaagugcgcaaggacaucccucagugggaacccagcaaaggguggaaugauuggcagcaggucccuuucugcucccaccauuuucaccaacucauuaugaaggacggccgggagaucgugguucccuguagaaaccaggaugagcuggugggacgcgcucgggucagccagggcgccggguggucucugagagaaacagcuugccucggaaaguccuacgcccaaauguggcagcugauguauuuccaucgccgggaccuuagacuggcugccaaugcgaucuguagcgccgugccggucgauugggugccuaccucucgcacgacaugguccauucacgcucaccaucaguggaugaccaccgaggacaugcucagcguuuggaaccggguguggaucgaagagaaucccuggauggaagauaaaacacaggucuccucuugggaggaggugcccuaccugggcaagagagaagaccaauggugcgggagccuuauuggacugaccgcccgggccacaugggcuacgaacauccagguugccauuaaucaggugagacgccucaucggcaacgagaauuaucuggacuacaugaccuccaugaaacgguuuaagaacgaaagcgauccugagggggcgcugugguga

SEQ ID NO: 18598 - RNA, 9879 nt, Artificial Sequence
  derived and/or modified CDS sequence (opt5) from DENV-1__KF955442__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgacgggacaaccguggucguggaugaacacugcggaaaucgcggccccucucugcggacaaccacgguuacaggcaagauuauccaugagugguguugcagaagcuguacccugccuccccuucgguuccgcggggaagacggaugcugguacggcauggagaucagaccggugaaagagaaggaagagaaccucguccgguccauggugagcgcggggucuggagaaguugacuccuuuagccugggcauucugugugcuuccaucaugauugaggaagugaugagaucucgcuggagccggaagaugcucaugacagggacccuggccgucuuccuucugcucaucaugggacaacugaccuggaaugaucugauuagacuuugcaucauggugggcgccaacgcuuccgaccgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggagcuucccaacucucuggaagagcucggggauggacuggccaugggcaucaugaugcucaagcugcuuacagaauuccagccccaccagcuguggaccacgcuccugagccugacauuuaucaaaaccacccuuucccuggacuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagagaauaagauuuggggccggaaauccuggccucuuaacgaaggcaucauggccauugggaucguuagcauccugcucucuucccugcucaagaaugaugugccccuggcgggaccucuuauugccggcgggaugcugaucgcuuguuaugugauuagcggauccagcgccgaccugucucucgagaaagcugccgaggucagcugggaacaagaggccgaacauuccggcaccucucacaacauccugguggagguucaggaugacgggacgaugaagauuaaagaugaagagcgcgacgauacccuuacaauccugcucaaggcuacccugcucgcggugagcggagucuaccccauguccaucccugccacacuguuugugugguauuucuggcagaaaaagaagcagagaucuggcguucuuugggacacccccagcccgccugagguggaacgggcuguccuggaugacggcauuuaccgcauccugcaaagagggcuccugggacggucccaggugggcgucgggguguuccaggacggaguuuuucauacaauguggcacgugacgcgcggcgccguccuuauguaucaggggaaaagacuggagcccucuugggccagcgugaagaaagaucucauuuccuacggaggcggcuggcgguuccaagggagcuggaauaccggagaagagguucaggugaucgcugucgagccuggcaagaaccccaaaaaugugcagacaaccccggggaccuuuaagacaccugaaggagaggugggcgccauugcgcuggacuucaagcccgggacgucuggauccccuaucguuaacagagaaggcaaaauugucggccucuacgggaauggaguggugaccacaagcggcaccuaugucucugcuaucgcccaagccaaggcuucccaggaggggccccugcccgaaaucgaggaugagguguuuaaaaagcgcaaccuuacaauuauggaccugcacccuggaagcggcaaaacccggagauaccugccggccaucguucgcgaagcgauuaagcggaagcucagaacgcugauccuugcucccacacgcguggucgccuccgagauggccgaagcucugaaagggaugccuauucgguaucagaccaccgccgugaagucugagcauacaggcagagaaaucguugaucucaugugccacgcuaccuucacaaugcgccugcugagccccgugcgggucccuaauuacaacaugaucauuauggacgaggcccauuuuaccgaucccgcguccaucgccgcuagaggauauauuagcacgcgggugggcaugggggaggccgcugccaucuucaugacagccaccccuccgggaucuguugaagcuuuuccccaguccaaugcggugauucaagacgaggaacgcgauaucccugagagaagcuggaacucuggcuacgacuggaucacagauuuccccgggaaaaccgucugguuugugccuagcauuaaguccggaaaugacaucgccaacugucuccggaaaaacggcaagcgcgugauucagcuuucuagaaagacguucgacaccgaauaucagaaaacaaagaauaacgauugggacuacgucguuaccacagauaucagcgagaugggggcuaauuuccgggccgacagagugauugauccccgccggugccugaaaccggugauccugaaggacggcccugagagagucauucucgccggacccaugcccgugaccguugcuuccgccgcgcagcgccggggcagaaucgggcgcaaccaaaauaaagaaggagaucaguacguguauaugggccagccucugaacaaugacgaggaucacgcucauuggacagaagccaagaugcuucuggacaacaucaauacccccgaggggauuaucccugcccucuuugagccggaacgggagaagucugcugccauugauggagaauacagacugcgcggcgaggcgagaaaaacguucgucgaacugaugcggcgcggggaccuccccguguggcuuagcuauaagguugccuccgagggcuuucaguacagcgauagacgguggugcuucgacggagagcgcaacaaucaagugcuggaagagaacauggacgucgaaaucuggacaaaagagggcgaaagaaagaaacugcggccuagauggcucgaugcucgcaccuauucugacccccuggcccuucgggaguuuaaggaguucgcugccgggagacgcuccgugagcggagaucugauucucgaaaucggcaaacugccucagcaccugacccuccgggcucagaaugcccuugacaaccuggucaugcugcacaauuccgagcaggggggaaaggcguacagacaugccauggaagagcuccccgauacaaucgaaacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaguuuuuccugaugguccuccugaucccugaacccgaccggcaacgcaccccucaggauaaccagcuggccuauguugugaucggacuccuuuuuaugauucugacaguggcugccaacgagaugggccugcucgaaaccacgaagaaagaccuggggaucggacaugucgccgcugagaaucaccaacacgccaccaugcuugauguggaccugagacccgcgagcgccuggacacucuacgcuguugccaccacagugauuaccccuaugaugcggcauacgaucgagaacacaaccgcuaauauuucucugacagccaucgcgaaccaggccgcuauucugaugggccucgauaagggcuggcccaucuccaaaauggacaucggggucccgcuucuggcccugggaugcuacagccaggugaauccucucacccugaccgcugccguccuuaugcugguggcucacuaugccauuaucggccccgggcuccaggcgaaggccacacgcgaagcucaaaagagaacggccgcuggaauuaugaaaaaccccaccguugauggcaucguggccauugaccuggacccugucguguacgaugccaaguucgagaaacagcuggggcagaucaugcuccuuauccuguguacaucucagauucugcucaugcggaccacaugggcgcugugcgaauccaucacccuugcuacgggaccgcugacaacccucugggagggcagccccggcaaguuuuggaauaccacaauugccguuucuauggcuaacaucuuccgcgggagcuaucuggccggagccggccuggcuuucucccucaugaaaucucuugggggaggcagacgggggaccggagcccaaggcgaaacacugggcgagaaguggaagcgccagcugaaucagcucagcaaauccgaguuuaacacguacaagagaagcgggauuauggaaguggaccgguccgaggcgaaagaaggacugaagagaggcgagaccacaaaacaugccgucucucgcgggaccgcuaagcuucggugguucguggaaagaaaucuggugaagccugagggaaaaguuaucgaucucggcugugggcgcggaggcuggagcuauuacugcgccggccugaagaaagucacagaggugaagggguauaccaaaggaggccccgggcacgaagagccuauccccauggcuacguacggauggaaccuggugaagcuccauuccggcaaagacgucuuuuucaugccuccggaaaagugugauacccuucugugcgacauuggggagucuagccccaauccuacaaucgaagagggacggacccugagaguucucaagaugguggagcccuggcugcgcggcaaccaguuuuguauuaaaauccuuaauccuuacaugcccuccguggucgaaacacuggagcaaaugcagcggaagcacggcgggaugcucgugagaaacccgcugucucgcaauagcacccacgaaauguauuggguuuccugcggaacaggcaacauugugagcgccgucaacaugaccucucggaugcugcucaauagauucacgauggcgcaucgcaaaccuacauuugagcgggauguggaccugggggccggaaccagacacguugcuguggagcccgaagucgccaaccuugauaucauuggccagcgcaucgagaauaucaagaacgaacauaaauccaccuggcacuacgacgaggauaaucccuauaagacaugggcuuaccacgggagcuaugaagugaagccuucuggauccgccagcucuauggugaacggcgucguuagacugcucacgaaacccugggacgugauuccuauggugacccaaaucgcuaugacagacaccacaccguucggccagcagcgggucuuuaaggagaaaguggauacccgcacacccagagccaagcgggggaccacgcagauuauggagguuaccgcgaaauggcuguggggauuccuuuccagaaauaagaagccucggaucuguacacgcgaagaguuuaccagaaaagugcggagcaacgccgcuauuggcgccgucuucguggacgaaaaucaauggaacuccgcuaaggaggccguugaagaugagcgcuuuugggaccuggugcauagagagcgggaacuccacaaacaggggaagugcgccacaugcgucuacaauaugaugggaaaacgcgagaagaagcugggcgaauucgggaaagcgaagggcagcagagcuaucugguauauguggcugggagcccgguuccucgaguuugaagcccugggcuucaugaacgaggaucauugguuuucucgcgagaauagccuuuccgggguggaaggagagggccugcacaaacucggguacauccugagagacauuucuaagauccccggaggcaacauguacgcugaugacaccgccgggugggauacgcggauuacagaagacgaucuucagaaugaggcuaaaaucaccgacauuauggagccugaacaugcccugcucgcgacaagcaucuucaagcugaccuaucagaacaaaguugugcgcguccaaagacccgccaagaacggcacggugauggaugucaucucccggcgcgaccagagaggaucuggccagguggggaccuacggacugaauacauuuaccaacauggagguucagcucauucggcaaauggaaagcgagggcaucuuccugccguccgaacuugagacaccuaaucuggcugagagagugcucgacuggcuggaaaagcacggggccgagcgccuuaaacggauggcuauuucuggagaugacugugucgugaagcccaucgaugacagauuugccaccgcgcugacagcccucaacgauaugggcaaagugcgcaaggacauuccucagugggaacccagcaaaggguggaaugauuggcagcagguuccuuucugcucccaccauuuucaccaacugaucaugaaggacggccgggagaucgugguccccuguagaaaccaggaugaacuggugggacgcgcucggguuagccagggcgccggguggucucucagagagaccgcuugccugggaaaguccuaugcccaaauguggcagcuuauguacuuccaucgccgggaccugagacucgcugccaaugcgauuuguagcgccgugccggucgauugggugccuacgucucgcacaaccugguccauccacgcucaccaucaguggaugaccacagaggacaugcugagcgucuggaaccggguguggauugaagagaaucccuggauggaagacaaaacccacguuuccucuugggaggaagugcccuaucuuggcaagagagaggaucaguggugcgggagccugaucggacucacagcccgggccacgugggcuaccaacauucaagucgccaucaaucaggugagacgccugauuggcaacgagaauuaccuggacuauaugacauccaugaaacgguuuaagaacgaaagcgauccugagggggcgcucugguga

SEQ ID NO: 18599 - RNA, 9879 nt, Artificial Sequence
  derived and/or modified CDS sequence (opt5) from DENV-1__GU131965__SS-prME
agcgugaccaugcugcucaugcugcuucccacagcccuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggugcuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaagaauaaacccacacuggauaucgaacuccugaagaccgagguuacaaacccugcuauucuucggaaacugugcaucgaagccaagauuucuaauaccacgacagacucccgcuguccgacccagggagaggcgacccucguggaagaacaggaugccaacuucgugugcagacggacauuugucgaccgcggcuggggcaauggguguggacuguucggcaaagggagccuucugaccugcgcuaaguuuaagugcgugacaaaacucgagggaaagaucguucaguacgaaaaccugaaauauucugugaucgucacggugcacaccggcgaucaacaucagguugggaaugagacaaccgaacacggaacaauugccaccaucacgccccaggcuccuaccuccgagauucagcugacagacuacggcgcccucacccuggacuguagccccagaacaggccuugauuucaacgaaauggugcugcucaccaugaaggagaaaucuuggcugguccauaagcaaugguuucuugaccugccucuccccuggacguccggggccagcacaucccaggagaccuggaaucggcaggaucugcuggugacauucaaaaccgcucacgcgaagaagcaagaagucgugguucucggaucucaggagggcgccaugcacaccgcucugacaggggccacggaaauccagaccagcggaacaaccacaauuuuugccggccaucuuaaaugccgccugaagauggacaaacucacccugaaggggacguccuaugugauguguacaggcagcuucaaacuggagaaggaagucgcugagacccagcacggaaccgugcuuguucaagugaaguacgagggcacagaugccccgugcaaaaucccuuucucuacccaggacgaaaagggggucacacagaacggaagacucaucacggcgaaucccauugugaccgauaaagagaagccugugaacaucgaaacagagccgcccuuuggcgaguccuauauuguugucggggcuggagaaaaagcccugaagcugagcugguucaagaaaggcucuagcaucgggaagauguuugaggccaccgcucggggcgccagacgcauggcuauucucggagacacagccugggauuucggcuccaucgggggaguguuuaccucugugggcaaacugguccaucagguguucgggacggcguacggaguucuuuuuagcggcguguccuggaccaugaagaucgggauuggcauccugcucacauggcugggacugaauagccggaacaccucucuuuccaugacauguauugccgucggcauggugacccucuaccuggggguuauggugcaagcugacagcggaugcgucaucaacuggaaaggcagagaacugaagugugggucuggaauuuucgugacaaaugagguucacaccuggacggaacaguauaaguuucaggccgauuccccuaaacgccucagcgcugccaucggcaaggcgugggaggagggggugugcggcauucgguccgccacaagacuggaaaacaucauguggaaacagaucucuaaugagcuuaaccauauucugcucgaaaaugacaugaaguucaccgucguggugggagacgcuaacggcauccuggcccaagggaaaaagaugauucgcccgcagcccauggagcacaaauacagcuggaaguccuggggaaaggcuaaaaucauuggcgccgauauccagaauaccacauuuaucauugacgggccugauacccccgaauguccugacaaccagcgggccuggaauaucugggaggucgaggauuauggauucggcauuuuuacgacaaacaucuggcugaaacuuagagacucuuacacccaaaugugcgaucaccgccucaugagcgcugcgauuaaagacuccaaggccguucaugcugauaugggcuauuggaucgaaagcgagaaaaaugaaacauggaagcuggcccgggccucuuucaucgaggugaagaccuguacauggcccaaaucccacacccuguggagcaacggggugcucgaaucugagaugauuaucccgaagauuuacggaggcccuaucucccagcauaauuauagacccggguacuucacgcagaccgcuggaccuuggcaccugggcaaacuugagcuggacuuugaucucugcgaagggacaaccgucgugguugacgagcacugcggaaaccgcggccccagccugcggacaaccacggccacaggcaagauuauccaugaaugguguugcagaucuuguacccugccuccccuucgguuccgcggggaggauggaugcugguacggcauggagaucagaccggugaaagaaaaggaggaaaaucucguccggagcaugguguccgcggggagcggagagguugacucuuuuucccugggcauucugugugcuagcaucaugauugaagaggugaugagaucccgcuggucucggaagaugcucaugacagggacccuggccgucuuccuucugcucgugaugggacaacugaccuggaacgaccugaucagacuuugcauuaugguuggcgccaacgcuagcgaucgcaugggcauggggacaacguaucuggcccucauggcgaccuuuaaaaugagaccuauguucgcugugggacugcucuuucggcgccugacauccagagagguccuucugcucaccaucggccugucucugguggccagcguggaacuucccaauucccuggaggaacucggggacggacuggccaugggcauuaugaugcucaagcugcuuacagaguuccagccccaccagcuguggaccacgcuccugucucugacauuuaucaaaaccacccuuagccuggauuacgcuuggaagacaaccgccauggcucucuccaucgucagccuguucccucucugucugucuacaacgucccagaaaaccacauggcuuccgguucugcuggggagcuuuggaugcaagccccucaccauguuccugauuacagaaaacaagaucuggggccggaaaucuuggccucuuaaugagggcauuauggccaucgggauuguguccauccugcucagcucucugcucaagaacgacgugccccuggcgggaccucuuaucgccggcgggaugcugauugcuuguuaugucaucuccggaagcuccgccgaucugagccucgagaaagcugccgaagugucuugggagcaagaagccgagcauagcggcaccucccacaauauucugguugaagugcaggacgaugggacgaugaagaucaaagacgaggagcgcgaugacacccuuacaauucugcucaaggcuacccugcucgcggucucuggaguguaccccaugagcaucccugccacacuguuuguuugguauuucuggcagaaaaagaagcagagauccggcgugcuuugggauacccccucuccgccugaagucgagcgggcugugcuggacgauggcaucuaccgcauucugcaaagagggcuccugggacggagccaggucggcguggggguuuuccaggacggaguguuucauacaauguggcacgucacgcgcggcgccgugcuuauguaucaggggaaaagacuggaacccuccugggccucuguuaagaaagaccucaucagcuacggaggcggcuggcgguuccaaggguccuggaacaccggagaggaggugcaggucauugcuguggaaccuggcaagaaucccaaaaacgugcagacaaccccggggaccuuuaagacaccugagggagaaguuggcgccaucgcgcuggauuucaagcccgggacgagcggaucuccuauugucaauagagagggcaaaaucgugggccucuacgggaacggaguggucaccacauccggcaccuaugugagcgcuauugcccaagccaaggcuucucaggaagggccccugcccgagaucgaggacgaaguuuuuaaaaagcgcaaucuuacaaucauggaucugcacccuggauccggcaaaacccggagauaccugccggccauugugcgcgaggcgaucaagcggaagcucagaacgcugauucuugcucccacacgcgucguggccagcgaaauggccgaggcucugaaagggaugccuauccgguaucagaccaccgccguuaaguccgaacauacaggcagagagauuguggaccucaugugccacgcuaccuucacaaugcgccugcugucucccguccgggugccuaacuacaauaugaucaucauggaugaggcccauuuuaccgaccccgcgagcauugccgcuagaggauauaucuccacgcggguuggcaugggggaagccgcugccauuuucaugacagccaccccuccgggaagcguggaggcuuuuccccagucuaacgcggucauccaagaugaagaacgcgacauuccugaaagauccuggaauagcggcuacgauuggaucacagacuuccccgggaaaaccgugugguuugugccuucuaucaagagcggaaacgauauugccaacugucuccggaaaaauggcaagcgcgucauccagcuuuccagaaagacguucgacaccgaguaucagaaaacaaagaacaaugacugggauuacguugugaccacagacauuucugagaugggggcuaacuuccgggccgauagagugaucgacccccgccggugccugaaaccggucauucugaaggauggcccugaaagagugauccucgccggacccaugcccguuaccguggcuagcgccgcgcagcgccggggcagaauugggcgcaaucaaaacaaagagggagaccaguacgucuauaugggccagccucugaauaacgaugaagaccacgcucauuggacagaggccaagaugcuucuggauaauaucaacacccccgaggggaucauuccugcccucuuugaaccggagcgggaaaaguccgcugccaucgacggagaguacagacugcgcggcgaagcgagaaaaacguucguggagcugaugcggcgcggggaucuccccguuuggcuuucuuauaagguggccagcgagggcuuucaguacuccgacagacgguggugcuucgauggagaacgcaauaaccaaguccuggaggaaaauauggacguggagauuuggacaaaagaaggcgagagaaagaaacugcggccuagauggcucgacgcucgcaccuauagcgauccccuggcccuucgggaguuuaaggaguucgcugccgggagacgcucugucuccggagaccugauccucgagauuggcaaacugccucagcaccugacccuccgggcucagaacgcccuugauaaucuggugaugcugcacaacagcgaacaagggggaaaggcguacagacaugccauggaggaacuccccgacacaaucgagacccugaugcuucuggcucucaucgccguucugacaggcggcgugacgcuguuuuuccucuccgggaagggacuuggcaaaaccucuauugggcugcugugugugacagcuagcuccgcccuccuguggauggccucugucgagccgcacuggaucgcugcgagcauuauccuugaauuuuuccugaugguucuccugauuccugagcccgaucggcaacgcaccccucaggacaaccagcuggccuauguggugaucggacuccuuuuuaugauccugacagucgcugccaaugaaaugggccugcucgagaccacgaagaaagaucuggggauuggacauguggccgcugagaaccaccaacacgccaccaugcuugacguugaucugagacccgcguccgccuggacacucuacgcuguggccaccacagucaucaccccuaugaugcggcauacgauugaaaauacaaccgcuaacaucagccugacagccauugcgaaucaggccgcuauccugaugggccucgacaagggcuggcccauuucuaaaauggauaucggggugccgcuucuggcccugggaugcuacucccaggucaacccucucacccugaccgcugccgugcuuaugcugguugcucacuaugccaucauuggccccgggcuccaggcgaaggccacacgcgaggcucaaaagagaacggccgcuggaaucaugaaaaaucccaccguggacggcauugucgccaucgaucuggacccugugguuuacgacgccaaguucgaaaaacagcuggggcagauuaugcuccuuauccuguguacaagccagauccugcucaugcggaccacaugggcgcugugcgagucuauuacccuugcuacgggaccgcugacaacccucugggaaggcucccccggcaaguuuuggaacaccacaaucgccgugagcauggcuaauauuuuccgcgggucuuaucuggccggagccggccuggcuuucagccucaugaaaucccuugggggaggcagacgggggaccggagcccaaggcgagacacugggcgagaaguggaagcgccagcugaaccagcucucuaaaagcgaauuuaauacguacaagagauccgggaucauggaggucgaucggagcgaagcgaaagagggacugaagagaggcgaaaccacaaaacaugccgugucccgcgggaccgcuaaacuucggugguucguggagagaaaccugguuaagccugagggaaaagucauugaccucggcugugggcgcggaggcuggucuuauuacugcgccggccugaagaaagugacagaagugaagggguauaccaaaggaggccccgggcacgaggaaccuauccccauggcuacguacggauggaaucuggucaagcuccauagcggcaaagauguguuuuucaugccuccggagaagugugacacccuucugugcgauaucggggaauccucucccaacccuacaauugaggagggacggacccugagaguucucaagaugguggaacccuggcugcgcggcaaucaguuuuguaucaaaauucuuaacccuuacaugcccagcgucguggagacacuggaacaaaugcagcggaagcacggcgggaugcucguuagaaauccgcugucccgcaacucuacccacgagauguauugggugagcugcggaacaggcaacaucgucuccgccgugaauaugaccagccggaugcugcucaacagauucacgauggcgcaucgcaaaccuacauacgagcgggacguugaucugggggccggaaccagacacguggcugucgaacccgagguggccaaucuugacauuaucggccagcgcauugaaaacaucaagaaugagcauaaaucuaccuggcacuaugaugaagacaaccccuacaagacaugggcuuaucacggguccuacgaggugaagccuagcggaucugccuccagcauggucaauggcguugugagacugcucacgaaacccugggaugugaucccuauggucacccaaauugcuaugacagacaccacaccguuuggccagcagcggguguucaaggagaaaguugacacccgcacacccagagccaagcgggggaccacgcagaucauggaagugaccgcgaaauggcuguggggauuucuuucuagaaacaagaagccucggauuuguacacgcgaggaguucaccagaaaaguccgguccaaugccgcuaucggcgccguguuuguugaugagaaccaauggaauagcgcuaaggaagccguggaggacgagcgcuucugggaucugguccauagagaacgggagcuccacaaacaggggaagugcgccacaugcguguauaacaugaugggaaaacgcgaaaagaagcugggcgaguuugggaaagcgaagggcuccagagcuauuugguacauguggcugggagcccgguuccucgaguucgaggcccugggcuuuaugaaugaggaccauugguucagccgcgaaaacucucuuagcgggguugagggagaaggccugcacaaacucggguacauccugagagauaucuccaagauucccggaggcaauauguaugcugacgauaccgccgggugggacacgcggaucacagaggaugaccuucagaacgaggcuaaaauuaccgaaaucauggagccugaacaugcccugcucgcgacaucuauuuuuaagcugaccuaccagaacaaagugguccgcgugcaaagacccgccaagaauggcacggucauggaugugaucagccggcgcgaccagagaggauccggccagguugggaccuauggacugaacacauucaccaauauggaggugcagcucauccggcaaauggaaucugagggcauuuuucugccgagcgagcuugaaacaccuaaccuggcugagagaguccucgauuggcuggaaaagcacggggccgagcgccuuaaacggauggcuaucuccggagacgacuguguggugaagcccauugaugacagauucgccaccgcgcugacagcccucaaugauaugggcaaaguucgcaaggacaucccucagugggaacccucuaaaggguggaacgauuggcaacaggugccuuuuugcagccaccauuuccaccaacugauuaugaaggacggccgggagaucgucgugcccuguagaaaucaggaugagcugguuggacgcgcucgggugucccagggcgccggguggagccucagagaaaccgcuugccugggaaagucuuacgcccaaauguggcagcuuauguauuuucaucgccgggaccugagacucgcugccaacgcgaucuguuccgccgucccgguggauugggucccuacgagccgcacaaccuggucuauucacgcucaccaucaguggaugaccacagaggacaugcuguccguguggaaucggguuuggaucgaagagaaccccuggauggaagauaaaacccacgugagcuccugggaggagguccccuaccuuggcaagagagaagaccaguggugcgggucucugauuggacucacagcccgggccacgugggcuaccaauauccaaguggccauuaaccagguuagacgccugaucggcaaugagaacuaucuggacuacaugacaagcaugaaacgguucaagaaugaauccgauccugagggggcgcucugguga

SEQ ID NO: 18600 - RNA, 9879 nt, Artificial Sequence
  derived and/or modified CDS sequence (opt5) from DENV-1__GU131966__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacgccaaguucgaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguuuuggaauaccacaauugccguuucuauggcuaacaucuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacagacggagcgggauuauggagguggauagauccgaagcgaaggagggacugaaacgcggcgaaaccacaaagcaugccgucucucgggggaccgcuaaacuuagaugguucguggagcgcaaucuggugaagccugagggaaagguuaucgaccucggcugugggcggggaggcuggagcuauuacugcgccggccugaaaaaggucacagaagugaaaggguauaccaagggaggccccgggcacgaggaaccuauccccauggcuacguacggauggaaccuggugaaacuccauuccggcaaggaugucuuuuucaugccuccggagaaaugugacacccuucugugcgauauuggggaaucuagccccaauccuacaaucgaggagggaagaacccugcgcguucucaagaugguggaacccuggcugcggggcaaccaguuuuguauuaagauccuuaauccuuacaugcccuccguggucgagacacuggaacaaaugcagagaaaacacggcgggaugcucgugcgcaacccgcugucucggaauagcacccacgagauguauuggguuuccugcggaacaggcaacauugugagcgccgucaacaugaccucuagaaugcugcucaaucgcuucacgauggcgcaucggaagccuacauuugagagagacguggaucugggggccggaacccgccacguugcuguggaacccgaggucgccaaccuugacaucauuggccagagaaucgaaaauaucaaaaacgagcauaaguccaccuggcacuacgaugaagacaaucccuauaaaacaugggcuuaccacgggagcuaugaggugaagccuucuggauccgccagcucuauggugaacggcgucguucggcugcucacgaagcccugggaugugauuccuauggugacccaaaucgcuaugacagacaccacaccguucggccagcagcgcgucuuuaaagagaagguggacaccagaacaccccgggccaaaagagggaccacgcagauuauggaaguuaccgcgaaguggcuguggggauuccuuucccggaauaaaaagccucgcaucuguacaagagaggaauuuacccggaaggugcgcagcaacgccgcuauuggcgccgucuucguggaugagaaucaauggaacuccgcuaaagaagccguugaggacgagagauuuugggaucuggugcaucgggaacgcgagcuccacaagcaggggaaaugcgccacaugcgucuacaauaugaugggaaagagagaaaaaaagcugggcgaguucgggaaggcgaaaggcagccgggcuaucugguauauguggcugggagcccgcuuccucgaauuugaggcccugggcuucaugaacgaggaccauugguuuucuagagaaaauagccuuuccgggguggagggagaaggccugcacaagcucggguacauccugcgggauauuucuaaaauccccggaggcaacauguacgcugacgauaccgccgggugggacacgcgcauuacagaggaugaccuucagaaugaggcuaagaucaccgauauuauggaaccugagcaugcccugcucgcgacaagcaucuucaaacugaccuaucagaacaagguugugagaguccaacggcccgccaaaaacggcacggugauggacgucaucucccgcagagaucagcggggaucuggccagguggggaccuacggacugaauacauuuaccaacauggaaguucagcucauuagacaaauggagagcgaaggcaucuuccugccguccgagcuugagacaccuaaucuggcugaacgcgugcucgacuggcuggagaagcacggggccgaacggcuuaagagaauggcuauuucuggagacgauugugucgugaaacccaucgacgaucgcuuugccaccgcgcugacagcccucaacgacaugggcaaggugcggaaagauauuccucagugggagcccagcaagggguggaaugacuggcagcagguuccuuucugcucccaccauuuucaccaacugaucaugaaagauggcagagaaaucgugguccccugucgcaaccaggacgagcuggugggacgggcuagaguuagccagggcgccggguggucucuccgcgagaccgcuugccugggaaaguccuaugcccaaauguggcagcuuauguacuuccaucggagagaucugcgccucgcugccaaugcgauuuguagcgccgugccggucgacugggugccuacgucucggacaaccugguccauccacgcucaccaucaguggaugaccacagaagauaugcugagcgucuggaacagaguguggauugaggaaaaucccuggauggaggacaagacccacguuuccucuugggaagaggugcccuaucuuggcaaacgggaggaccaguggugcgggagccugaucggacucacagccagagccacgugggcuaccaacauucaagucgccaucaaucaggugcgccggcugauuggcaacgaaaauuaccuggauuauaugacauccaugaagagauuuaaaaacgagagcgacccugaaggggcgcucugguga

SEQ ID NO: 18601 - RNA, 9879 nt, Artificial Sequence
  derived and/or modified CDS sequence (opt5) from DENV-1__GQ868501__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaaucaaauuuggggccggaaguccuggccucuuaacgagggcaucauggccauugggaucguuagcauccugcucucuucccugcucaaaaaugacgugccccuggcgggaccucuuauugccggcgggaugcugaucgcuuguuaugugauuagcggauccagcgccgaucugucucucgagaagaccgcugaagucagcugggagcaggaagccgagcauuccggcacgucucacaacauccugguggaaguucaggacgaugggaccaugaaaauuaaggacgaggagcgcgaugacacacuuaccauccugcucaaagccacacugcucgcugugagcggagucuaccccauguccaucccugcgacccuguuugugugguauuucuggcagaagaaaaagcaaagaucuggcguucuuugggauacacccagcccgccugaaguggagcgggccguccuggacgauggcauuuaccgcauccugcagagagggcuccugggacggucccaggugggcgucgggguguuccaggacggaguuuuucauacgauguggcacgugacccgcggcgcuguccuuauguaucaagggaagagacuggaacccucuugggccagcgugaaaaaggaccucauuuccuacggaggcggcuggcgguuccaggggagcuggaauacaggagaggagguucaggugaucgccgucgaaccuggcaaaaaccccaagaaugugcaaaccaccccggggacauuuaaaacgccugagggagaagugggcgcuauugcccuggauuucaagcccgggaccucuggauccccuaucguuaacagagagggcaagauugucggccucuacgggaauggaguggugacaaccagcggcacauaugucucugcgaucgcucaggccaaagccucccaggaagggccccugcccgagaucgaggacgaaguguuuaagaaacgcaaccuuaccauuauggaucugcacccuggaagcggcaagacgcggagauaccugccggcuaucguucgcgaggccauuaaacggaagcucagaacacugauccuugcgcccacccgcguggucgcuuccgaaauggccgaggcccugaaggggaugccuauucgguaucagaccacagcugugaaaucugaacauaccggcagagagaucguugaccucaugugccacgccacauucaccaugcgccugcugagccccgugcgggucccuaauuacaacaugaucauuauggaugaggcucauuuuacggaccccgccuccaucgcggccagaggauauauuagcacacgggugggcaugggggaagcugccgcuaucuucaugaccgccacaccuccgggaucuguugaggccuuuccccaauccaaugcugugauucaggaugaagagcgcgacaucccugaaagaagcuggaacucuggcuacgauuggaucaccgacuuccccgggaagacggucugguuugugccuagcauuaaauccggaaaugauaucgcgaacugucuccggaagaacggcaaacgcgugauucagcuuucuagaaagaccuucgacacagaguaucagaagaccaaaaauaacgacugggauuacgucguuacaaccgacaucagcgagaugggggccaauuuccgggcugauagagugauugacccccgccggugccugaagccggugauccugaaagauggcccugaaagagucauucucgccggacccaugcccgugacaguugccuccgcugcccaacgccggggcagaaucgggcgcaaccagaauaaggagggagaccaguacguguauaugggccagccucugaacaaugaugaagaccacgcgcauuggaccgaggcuaaaaugcuucuggauaacaucaauacgcccgaggggauuaucccugcccucuuugaaccggagcgggaaaagucugccgcuauugacggagaguacagacugcgcggcgaagccagaaagacauucgucgagcugaugcggcgcggggaucuccccguguggcuuagcuauaaaguugcguccgagggcuuucaauacagcgacagacgguggugcuucgauggagaacgcaacaaucaggugcuggaggaaaacauggacgucgagaucuggaccaaggaaggcgagagaaaaaagcugcggccuagauggcucgacgcccgcaccuauucugauccccuggcucuucgggaguuuaaagaauucgccgcugggagacgcuccgugagcggagaccugauucucgagaucggcaagcugccucagcaccugacacuccgggcccagaaugcucuugauaaccuggucaugcugcacaauuccgaacaagggggaaaagccuacagacaugcgauggaggaacuccccgacaccaucgagacacugaugcuucuggcccucauugcugugcugacgggcggcguuacccuguuuuuccucucugggaagggacuuggcaagacaagcaucgggcugcugugugugaccgccuccucugcucuccuguggauggccagcguggagccgcacuggauugccgcuuccaucauucuugaauuuuuccugaugguccuccugaucccugagcccgaucggcagcgcacaccucaggacaaccaacuggcguauguugugaucggacuccuuuuuaugauucugaccguggccgcuaacgaaaugggccugcucgagacgaccaaaaaggaucuggggaucggacaugucgccgccgagaaucaccagcacgcuacaaugcuugacguggaucugagacccgccagcgcguggacccucuacgccguugcuacaaccgugauuacgccuaugaugcggcauacaaucgaaaacaccacagccaauauuucucugaccgcuaucgccaaccaggcggccauucugaugggccucgacaaaggcuggcccaucuccaagauggauaucggggucccgcuucuggcucugggaugcuacagccaggugaauccucucacccugacagccgcuguccuuaugcugguggcccacuaugcuauuaucggccccgggcuccaagccaaagcgacgcgcgaggcccagaagagaaccgcugccggaauuaugaagaaccccacaguugacggcaucguggcuauugaucuggacccugucguguacgacgccaaauucgaaaagcagcuggggcagaucaugcuccuuauccuguguaccucucaaauucugcucaugcggacaaccugggcccugugcgaguccaucacgcuugcgacaggaccgcugaccacccucugggaaggcagccccggcaaauuuuggaauacaaccauugcuguuucuauggccaacaucuuccgcgggagcuaucuggcuggagccggccuggccuucucccucaugaagucucuugggggaggcagacgggggacaggagcucagggcgagacgcugggcgagaaauggaagcgccagcugaaucagcucagcaaguccgaauuuaacaccuacaaaagaagcgggauuauggagguggaucgguccgaagccaaggagggacugaaaagaggcgaaacaaccaagcaugcggucucucgcgggacagccaaacuucggugguucguggagagaaaucuggugaagccugagggaaagguuaucgaccucggcugugggcgcggaggcuggagcuauuacugcgcuggccugaaaaaggucaccgaagugaaaggguauacgaagggaggccccgggcacgaggaaccuauccugauggccaccuacggauggaaccucguggagcuucauuccggcaaagaugucuuuuucaugcccccugaaaagugugacacacugcugugcgauauuggggagucuagcccgaaucccaccaucgaggaaggacggacacucagaguucugaaaaugguggagccuuggcuucgcggcaaccaauuuuguauuaagauccugaaucccuacaugccuuccguggucgaaacccucgagcagaugcagcggaagcacggcgggaugcuggugagaaacccccugucucgcaauagcacacacgagauguauuggguuuccugcggaaccggcaacauugugagcgcugucaacaugacgucucggaugcuccugaauagauucacaauggcccaucgcaaaccgaccuuugaacgggacguggaucuuggggcgggaaccagacacguugccguggagccugaagucgcuaaccuggacaucauuggccaacgcaucgagaauaucaagaacgaacauaaauccacauggcacuacgaugaggacaaucccuauaagacgugggccuaccacgggagcuaugaggugaaacccucuggauccgcuagcucuauggugaacggcgucguuagacuccugaccaagccuugggaugugauucccauggugacacagaucgccaugaccgacacaaccccuuucggccagcagcgggucuuuaaggaaaaaguggacacacgcaccccgagagcuaagcgggggacgacccaaauuauggagguuacagccaaauggcuuuggggauuccuguccagaaauaagaaaccccggaucuguacccgcgaagaguuuacaagaaaggugcggagcaacgcggccauuggcgcugucuucguggaugaaaaucaguggaacuccgccaaggaggcuguugaggacgaacgcuuuugggaucucgugcauagagagcgggaacugcacaaacaggggaagugcgccaccugcgucuacaauaugaugggaaaacgcgagaagaaacugggcgaauucgggaaggccaagggcagcagagcgaucugguauauguggcucggagcucgguuccuggaguuugaggcccuuggcuucaugaacgaagaccauugguuuucucgcgagaauagccuguccgggguggaaggagagggccuccacaaacugggguacauccuuagagauauuucuaagaucccuggaggcaacauguacgccgacgauacggcugggugggacacacggauuaccgaggaugaccugcagaaugaagccaaaaucacagauauuauggagcccgaacaugcucuccuggccaccagcaucuucaagcugacguaucaaaacaaaguugugcgcguccagagaccugcgaagaacggcaccgugauggacgucaucucccggcgcgaucagagaggaucuggccagguggggacauacggacucaauaccuuuacaaacauggagguucaacugauucggcagauggaaagcgagggcaucuuccuucccuccgagcuggaaaccccgaaucucgccgagagagugcuggacuggcuugaaaaacacggggcugagcgccugaagcggauggccauuucuggagacgauugugucgugaagccuaucgacgauagauuugcuacagcccucaccgcgcugaacgacaugggcaaagugcgcaaggauauuccccagugggaaccuagcaaaggguggaaugacuggcagcaaguucccuucugcucccaccauuuucaccagcugaucaugaaggauggccgggagaucguggucccuuguagaaaccaggacgagcucgugggacgcgcccggguuagccaaggcgcuggguggucucugagagaaacggccugccuuggaaaauccuaugcucagauguggcagcugauguacuuccaucgccgggaucucagacuggccgcuaaugccauuuguagcgcggugcccgucgacugggugccgacaucucgcaccaccugguccauccacgcccaccaucaguggaugacaaccgaggauaugcuuagcgucuggaaccggguguggauugaagagaauccuuggauggaagacaagacacacguuuccucuugggaggaggugcccuaucugggcaagagagaagaccaauggugcgggagccucaucggacugacggcucgggccaccugggccacaaacauucaggucgcuaucaaucaggugagacgccugauuggcaacgagaauuaccucgauuauaugaccuccaugaaacgguuuaagaacgaaagcgaccccgagggggcccugugguga

SEQ ID NO: 18602 - RNA, 9879 nt, Artificial Sequence
  derived and/or modified CDS sequence (opt5) from DENV-1__HQ166035__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauuagacugacagacuacggcgcccucacccuggacuguagcccccggacaggccuugauuucaacgaaaugguucugcucaccaugaaggagaaaucuuggcuggugcauaagcagugguuucuugaccugccucuccccuggacguccggggcuagcacaucccaagagaccuggaaucgccaggaucugcuggucacauucaaaaccgcgcacgccaagaagcaggaaguggucgugcucggaucucaagagggcgcuaugcacaccgcccugacaggggccacggaaauccagaccagcggaacaaccacaauuuuugcuggccaucuuaaaugcagacugaagauggacaaacucacccugaaggggacguccuauguuauguguacaggcagcuucaaacuggagaaggaaguggccgagacccagcacggaaccguccuugugcagguuaaguacgagggcacagaugcgccgugcaaaaucccuuucucuacccaagacgaaaagggggugacacagaacggacggcucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgccagaggcgcucgccggauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagcagaucuaccucccuuagcaugacauguauugcugugggcauggucacccucuaccugggggugaugguucaggccgacucuggaugcgugaucaacuggaaaggccgcgaacugaaguguggguccggaauuuucgucacaaacgaggugcacaccuggacggaacaauauaaguuucaggcugauagcccuaaacggcucuccgccgcgaucggcaaggccugggaggaggggguuugcggcauuagaucugcuacacgccuggaaaauaucauguggaaacagaucagcaacgagcuuaaucauauucugcucgaaaacgacaugaaguucaccguggucgugggagacgccaauggcauccuggcucaggggaaaaagaugauucggccgcaacccauggagcacaaauacuccuggaagucuuggggaaaggccaaaaucauuggcgccgauauccagaacaccacauuuaucauugacgggccugauacccccgaauguccugacaaucagagagcuuggaacaucugggagguggaggauuauggauucggcauuuuuacgacaaauaucuggcugaagcuucgcgacagcuacacccagaugugcgaucaccggcucauguccgcggccauuaaagacagcaaggcuguccaugccgauaugggcuauuggaucgaaucugagaaaaacgaaacauggaagcuggccagagcuuccuucaucgagguuaagaccuguacauggcccaaaagccacacccuguggucuaauggggugcucgaauccgagaugauuaucccgaagauuuacggaggcccuaucagccaacauaacuaucgccccggguacuucacgcagaccgccggaccuuggcaccugggcaaacuugagcuggacuuugaucucugcgaagggacaaccguggucguggacgagcacugcggaaaucggggccccucucugagaacaaccacgguuacaggcaagauuauccaugaaugguguugccggagcuguacccugccuccccuucgcuucagaggggaggauggaugcugguacggcauggagauccggccggugaaagaaaaggaggaaaaccucgucagauccauggugagcgcggggucuggagagguugacuccuuuagccugggcauucuguguguguccaucaugauugaagaggucaugcgcucucgguggagcagaaagaugcucaugacagggacccuggcuguguuccuucugcucguuaugggacagcugaccuggaaugaccugauccgccuuugcauuauggugggcgccaacgccuccgauagaaugggcauggggacaacguaucuggcucucauggccaccuuuaaaaugcggccuauguucgcggucggacugcucuuucgcagacugacaucucgggaggugcuucugcucaccaucggccugagccugguggcuuccgucgaacuucccaacucucuggaggaacucggggacggacuggccaugggcauuaugaugcucaagcugcuuacagaguuccaaccccaccagcuguggaccacgcuccugagccugacauuuaucaaaaccacccuuucccuggauuacgccuggaagacaaccgcuauggcccucagcaucguuucucuguucccucucugucuguccacaacgagccagaaaaccacauggcuuccggugcugcuggggucuuuuggaugcaagccccucaccauguuccugauuacagaaaauaagaucuggggccgcaaauccuggccucuuaacgagggcauuauggcuaucgggauugugagcauccugcucucuucccugcucaagaaugacgucccccuggccggaccucuuaucgcgggcgggaugcugauugccuguuaugugaucagcggauccagcgcugaucugucucucgagaaagccgcugaaguuagcugggagcaggaagccgagcauuccggcaccucucacaacauucugguggaaguccaagacgaugggacgaugaagaucaaagacgaggagagagaugacacccuuacaauucugcucaaggccaccaugcuggcugugagcggaguuuaccccauguccaucccugcgacacccuuugugugguauuucuggcagaaaaagaagcagcggauccgcguccucugggauaccccgucuccucccgaaguggagagagccguccuggacgauggcauuuaccggauccuucagcgcggccugcuggggagaagccaagugggaguuggcguguuccaggacggggucuuucauacaauguggcacgugacgcggggagcuguucucauguaucagggcaaaagacuggaaccuuccugggccucugugaagaaagaccuuauuagcuacgggggaggcuggcgcuuccagggcuccuggaauaccggggaggagguccaagugaucgccguggaacccggaaagaacccgaaaaauguucagacaaccccuggcaccuuuaagacacccgagggggaagucggagcuauugcccuggauuucaagccuggcacgagcgggucucccaucgugaaccgggaggaaaaaauugugggacucuacggcaauggcgucgugaccacauccgggaccuauguuagcgcgaucgcucaggccaaggccucucaagagggaccccugccugagaucgaagacgagguguuuaaaaagagaaaccucacaauuauggaucugcacccgggcuccgggaaaacccgccgguaccuucccgcuaucgucagagaagccauuaagcgcaagcugcggacgcugauccucgcgccuacaagagugguugcuagcgagauggccgaagcccugaaaggaaugcccauucgcuaucagaccaccgcugugaaguccgagcauacaggccgggagaucgucgaccuuaugugccacgccaccuucacaaugagacugcucucuccugugcggguucccaauuacaacaugaucauuauggaugaagcucauuuuaccgacccugccagcaucgcggcccgcggguauauuuccacgagagugggcaugggagaggcugccgcuaucuucaugacagccaccccgcccggcagcgucgaagccuuuccucagucuaaugcugugauucaggaugaggaacgggacauccccgagcgcuccuggaacagcggguacgauuggaucacagacuucccuggaaaaaccgugugguuuguccccucuauuaagagcggcaaugauaucgcgaacugucugagaaaaaacgggaagcggguuauucaacuguccagaaagacguucgacaccgaguaucagaaaacaaagaauaacgacugggauuacguggugaccacagacaucucugaaaugggagccaauuuccgcgcugaucgggucauugacccgagacgcugccucaaaccugugauccuuaaggauggccccgagcggguuauucuggccgggcccaugccugugaccgucgccagcgcugcccagagacgcggccggaucggaagaaaccagaauaaagaaggcgaccaauacguguauauggggcagccccugaacaaugaugaggaccacgcgcauuggacagaggcuaagaugcuccuggauaacaucaauaccccugaaggaauuaucccggcccuuuuugagcccgaacgcgagaaguccgccgcuauugacggcgaauacagacugcggggggaggcccgcaaaacguucguugagcucaugagacggggagaucugccuguguggcugucuuauaaggucgcgagcgaaggcuuucaguacuccgaccgcagauggugcuucgauggggagcggaacaaucaggugcucgaagagaacauggacgucgaaaucuggacaaaagagggcgagagaaagaaacuucgcccccgguggcuggacgccagaaccuauagcgauccucuggcucuccgcgaauuuaaggaguucgccgcuggacggagaucuguguccggcgaccugauucuugaaaucgggaaacugccccaacaccucacccugcgggcccagaaugcucuggauaaccucguuaugcuucacaauagcgagcagggaggcaaggccuaccgccaugcgauggaagagcugccggacacaaucgagacccugaugcuccuggcccuuauugcugugcugacagggggagugacgcucuuuuuccuguccggcaagggccuggggaaaaccucuaucggacuccuuugugucacagccagcuccgcucugcuguggauggccucuguugaaccucacuggauugccgcuagcaucauucucgaguuuuuccugauggugcuucugauccccgaaccugauagacagcggaccccccaagacaaccagcucgcguauguggucaucggccugcuguuuaugauucucacaguggccgcuaacgagauggggcuucuggagaccacgaagaaagaucugggaaucggccauguugccgccgaaaaucaccagcacgcuaccaugcucgacguggaucugcgcccugccuccgcguggacacuuuacgccgucgcuaccacagugauuacccccaugaugagacauacgaucgagaacacaaccgccaauauuagccugacagcuaucgccaaccaagcggccauucucauggggcuggacaagggauggccgaucucuaaaauggauaucggcgucccucugcucgcucuuggcugcuacucccaggugaauccccugacccugaccgccgcuguucucaugcugguggcccacuaugcuauuaucgggcccggacuucaggccaaggcgacacgggaagcccagaagcgcacggcugccggcauuaugaaaaacccuaccgucgacgggaucguggcuauugaucuggacccgguuguguacgacgccaaguucgagaaacaacucggacagaucaugcugcugauccucuguacaagccagauucuucugaugagaaccacaugggcccugugcgaaucuaucacccucgcgacgggcccccugacaacccuuugggagggguccccuggaaaguuuuggaauaccacaauugcugucagcauggccaacaucuuccggggcucuuaucuggcuggcgccgggcucgccuucagccugaugaaaucccugggaggcgggcgcagaggaaccggcgcucagggggagacacucggagaaaaguggaagcggcaacuuaaucagcugucuaaaagcgaguuuaacacguacaagagauccggcauuauggaaguggaucgcagcgaggccaaagaaggccugaagcggggggagaccacaaaacaugcgguguccagaggaaccgccaagcuccgcugguucguugagcggaaucuggucaagcccgaaggcaaagugaucgaccuuggguguggaagaggcggguggucuuauuacugcgcuggacugaagaaagugacagaggucaagggcuauaccaaaggcgggccuggacacgaagagcccaucccuauggccacguacggcuggaaccucguuaagcugcauagcgggaaagauguguuuuucaugccgcccgaaaagugugacacccugcucugcgauauuggagaguccucuccuaaucccacaaucgaggaaggccgcacccuucgggugcugaagauggucgagccuuggcugagagggaaccaguuuuguauuaaaauccucaaucccuacaugccgagcgugguugaagcucuggagcagaugcaacgcaagcacggaggcaugcuugugcggaacccucuguccagaaauucuacacacgagauguauugggucagcugcggcaccgggaacauuguguccgccguuaacaugacaagccgcaugcuccugaaucgguucaccauggcgcauagaaaacccacguacgaacgcgacguggaucugggagccggcacaagacacgucgcuguggagcccgaaguggccaaccucgacaucauugggcagcggaucgagaauaucaagaacgaacauaaaucuaccuggcacuaugaugaggacaauccuuacaagaccugggcuuaucacggauccuacgaggucaagcccagcggcucugccuccagcaugguuaacgggguggugcgccugcuuacaaaaccuugggaugucauuccgauggugacgcagaucgcuaugaccgacacaacccccuuuggacaacagagaguuuucaaggaaaaaguggacacacggaccccuagagccaagcggggcacaacccagauuauggaggucacggcgaaauggcuguggggcuuucucucucgcaauaagaagcccagaaucuguacccgggaagaguucacacgcaaagugagauccaacgccgcuauuggggccguuuuuguggaugaaaaucaguggaacagcgcuaaggaggccgucgaggacgaacgguucugggaucuggugcaucgcgagagagaacuucacaaacaaggaaagugcgccaccugcguuuauaauaugaugggcaaacgggagaagaagcugggggaauuuggaaaagcgaagggcucccgcgcuaucugguacauguggcucggggccagauuccuggaguucgaggcccugggcuuuaugaacgaagaccauugguucagccgggagaauucucucagcggaguggaaggcgaggggcugcacaaacuuggauacauccugcgcgauauuuccaagaucccuggcgggaacauguaugcugacgauacagccggaugggacaccagaauuacggaggaugaccuccagaaugaagcuaaaaucacagagauuauggaacccgagcaugcccugcuugcgaccucuaucuuuaagcugacauaccagaacaaagucgugcggguccagcgcccggccaagaacggcaccgugauggauguuaucagcagacgggaccaaagaggguccggccaggugggaacguauggccucaauaccuucacaaacauggaaguccagcugauucgccagauggagucugaggggaucuuucugccuagcgaacucgagacccccaaucuggcugaacgggugcuugauuggcuggagaagcacggagccgaaagacucaaacgcauggcuauuuccggcgacgacugugugguuaagccuaucgaugaccgguucgccacagcgcugaccgcccuuaacgauauggggaaagugagaaaggacauuccccaaugggagccuucuaaaggauggaaugauuggcagcagguccccuuuugcagccaccauuuccaccagcugaucaugaaggacggccgcgagaucgugguuccgugucggaaccaagaugaacucguggggagagcucgcgucucccagggcgccggauggagccugcgggagacagcuugccugggcaagucuuacgcccagauguggcaacucauguauuuucauagacgcgaccugcggcuugcugccaaugcgauuuguuccgccgugccugucgauugggugcccaccagcagaacgacauggucuauccacgcucaccaucaguggaugaccaccgaagacaugcuguccguuuggaaccggguguggauugaggaaaaucccuggauggaggauaaaacacacgucagcuccugggaggaagugccuuaccucgggaagagagaggaccaguggugcggaucucugaucggccuuaccgcccgcgccacaugggcuacgaacauucagguugccaucaaucaagugcggagacugauugggaacgaaaauuaucucgacuacaugaccagcaugaaacgcuucaagaacgaguccgauccggagggagcgcugugguga

SEQ ID NO: 18603 - RNA, 9879 nt, Artificial Sequence
  derived and/or modified CDS sequence (opt5) from DENV-1__GQ868502__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaccaucuucauucugcuuaugcuggcuacaccuagcauggccaugcgcugcgucggcaucgggaacagagauuuuguggagggacucuccggcgcuacguggguugacgugguccuggagcacgggagcugugugaccacaauggccaagaauaaacccacccuggauauugaacuccugaagacagaggugaccaacccugcgauccuucggaaacugugcauugaagccaagaucucuaauacgacaaccgacucccgcuguccgacccagggagaggcuacacucgucgaagagcaggaugccaacuucguuugcagacggaccuuuguggaccgcggcuggggcaauggguguggacuguucggcaaagggagccuucugacaugcgcuaaguuuaagugcgugacgaaacucgagggaaagaccguccaguacgaaaaccugaaauauucugugauuguuacagugcacaccggcgaucaacaucaggucgggaaugagacaaccgaacacggaacgaucgccaccaucacaccccaggccccuaccuccgagauucagcugacagacuacggcgcucucacccuggacuguagccccagaacgggccuugauuucaacgaaauggugcugcucacaaugaaggagaaaucuuggcugguucauaagcaaugguuucuugaccugccucuccccuggaccuccggggcgagcacaucccaggagaccuggaaucggcaggaucugcuggugaccuucaaaacagcccacgcuaagaagcaagaagucgugguccucggaucucaggagggcgccaugcacacggcccugaccggggcuacagaaauccagaccagcggaacaaccacgauuuuugccggccaucuuaaaugccgccugaagauggacaaacucacacugaaggggaccuccuaugugauguguaccggcagcuucaaacuggagaaggaaguugcggagacacagcacggaaccgugcuuguccaagugaaguacgagggcacagaugcuccgugcaaaaucccuuucucuacgcaggacgaaaaggggguuacccagaacggaagacucauuacagccaaucccaucgugaccgauaaagagaagccugucaacaucgaaacagagccccccuuuggcgaguccuauauuguggugggggccggagaaaaagcucugaagcugagcugguucaagaaaggcucuagcaucgggaagauguuugaggccaccgcucggggcgccagacgcauggcgauucucggagacacggccugggauuucggcuccaucgggggaguuuuuaccucugucggcaaacuggugcaucagguguucgggacagcuuacggaguccuuuuuagcggcguguccuggaccaugaagauugggaucggcauccugcucacauggcugggacugaauagccggucuaccucccuuagcaugacauguauugccguuggcauggugacccucuaccugggggucauggugcaagcugacucuggaugcguuaucaacuggaaaggcagagaacugaaguguggguccggaauuuucgugacgaacgagguccacacauggaccgaacaguauaaguuucaggccgauagcccuaaacgccucuccgcggccaucggcaaggcuugggaggagggggugugcggcauucggucugccaccagacuggaaaauaucauguggaaacagauuagcaacgagcuuaaucauauccugcucgaaaacgacaugaaguucacaguuguggucggagacgcuaauggcauccuggcccaagggaaaaagaugauucgcccgcagcccauggagcacaaauacuccuggaagucuuggggaaaggccaaaaucauuggcgcugauauccagaacaccacguuuauuaucgacgggccugauacacccgaauguccugacaaucagcgggcguggaacaucugggagguggaggauuauggauucggcauuuuuaccacaaauaucuggcugaagcuuagagacagcuacacccaaaugugcgaucaccgccucauguccgccgcuauuaaagacagcaaggccgugcaugccgauaugggcuauuggaucgaaucugagaaaaacgaaacauggaagcuggcucgggccuccuucauugaggucaagaccuguacguggcccaaaagccacacccuguggucuaaugggguucucgaauccgagaugaucaucccgaagauuuacggaggcccuaucagccagcauaacuauagacccggguacuucacacagaccgcgggaccuuggcaccugggcaaacuugagcuggacuuugaucucugcgaagggacaaccgugguggucgacgagcacugcggaaaucgcggccccucucugcggacgacaaccgugacaggcaagauuauccaugaaugguguugcagaagcuguacccugccuccccuucgguuccgcggggaggauggaugcugguacggcauggagauuagaccgguuaaagaaaaggaggaaaaccucgugcgguccauggucagcgcugggucuggagagguggacuccuuuagccugggcauccugugugccuccaucaugauugaagagguuaugagaucucgcuggagccggaagaugcucaugaccgggacacuggccguguuccuucugcucgucaugggacaacugacguggaaugaccugaucagacuuugcauuauggugggcgcuaacgccuccgaucgcaugggcauggggaccacauaucuggcgcucauggcuaccuuuaaaaugagaccuauguucgccguuggacugcucuuucggcgccugacaucuagagaggugcuucugcucaccaucggccugagccuggucgccuccguggaacuucccaacucucuggaggaacucggggacggacuggcuaugggcauuaugaugcucaagcugcuuacggaguuccagccccaccagcuguggacaacccuccugagccugaccuuuaucaaaacaacccuuucccuggauuacgccuggaagacaacggcuauggcccucagcauugugucucuguucccucucugucuguccaccacaagccagaaaaccacauggcuuccgguccugcuggggucuuuuggaugcaagccccucaccauguuccugaucacggaaaauaagaucuggggccggaaauccuggccucuuaacgagggcauuauggcgaucgggauuguuagcauccugcucucuucccugcucaagaaugacgugccccuggccggaccucuuauugcuggcgggaugcugaucgccuguuaugugaucagcggauccagcgcugaucugucucucgagaaagccgccgaagucagcugggagcaagaagcugagcauuccggcaccucucacaacauucugguggaaguucaggacgaugggacaaugaagaucaaagacgaggagcgcgaugacacccuuacaauucugcucaaggcgacccugcucgccgugagcggagucuaccccauguccaucccugcuacacuguuugugugguauuucuggcagaaaaagaagcagagaucuggcguucuuugggauacgcccagcccgccugaaguggagcgggccguccuggacgauggcauuuaccgcauccugcaaagagggcuccugggacggucccaggugggcgucgggguguuccaggacggaguuuuucauaccauguggcacgugacacgcggcgccguccuuauguaucaggggaaaagacuggaacccucuugggcuagcgugaagaaagaccucaucuccuacggaggcggcuggcgguuccaagggagcuggaauaccggagaggagguucaggugauugccgucgaaccuggcaagaaccccaaaaaugugcagaccacaccggggacguuuaagaccccugagggagaagugggcgcgaucgcucuggauuucaagcccgggacaucuggauccccuauuguuaacagagagggcaaaaucgucggccucuacgggaauggaguggugaccacaagcggcaccuaugucucugccauugcccaagcuaaggccucccaggaagggccccugcccgagaucgaggacgaaguguuuaaaaagcgcaaccuuacgauuauggaucugcacccuggaagcggcaaaacacggagauaccugccggcgaugguucgcgaggcuaucaagcggaagcucagaacccugauccuugcccccacccgcguggucgccuccgaaauggcugaggcccugaaagggaugccuauucgguaucagacaaccgcugugaagucugaacauacaggcagagagaucguugaccucaugugccacgccaccuucacgaugcgccugcugagccccgugcgggucccuaauuacaacaugauuaucauggaugaggcgcauuuuacagaccccgccuccauugcugccagaggauauaucagcacccgggugggcaugggggaagcugccgccaucuucaugacagcuaccccuccgggaucuguugaggcguuuccccaguccaaugccgugauucaagaugaagagcgcgacaucccugaaagaagcuggaacucuggcuacgauuggauuacggacuuccccgggaaaaccgucugguuugugccuagcaucaaguccggaaaugauauugcuaacugucuccggaaaaacggcaagcgcgugauccagcuuucuagaaagacauucgacaccgaguaucagaaaacaaagaauaacgacugggauuacgucguuaccacagacaucagcgagaugggggccaauuuccgggccgauagagugauugacccccgccggugccugaaaccggugauccugaaggauggcccugaaagagucauucucgcuggacccaugcccgugaccguugccuccgcggcucagcgccggggcagaaucgggcgcaaccaaaauaaagagggagaccaguacguguauaugggccagccucugaacaaugaugaagaccacgcccauuggacggaggccaagaugcuucuggauaacauuaauacacccgaggggaucauuccugcucucuuugaaccggagcgggaaaagucugccgcgaucgacggagaguacagacugcgcggcgaagccagaaaaaccuucgucgagcugaugcggcgcggggaucuccccguguggcuuagcuauaagguugcuuccgagggcuuucaguacagcgacagacgguggugcuucgauggagaacgcaacaaucaagugcuggaggaaaacauggacgucgagaucuggaccaaagaaggcgagagaaagaaacugcggccuagauggcucgacgcccgcacauauucugauccccuggcucuucgggaguuuaaggaauucgccgcugggagacgcuccgugagcggagaccugauucucgagaucggcaaacugccucagcaccugacccuccgggcccagaaugcgcuugauaaccuggucaugcugcacaauuccgaacaggggggaaaggccuacagacaugcuauggaggaacuccccgacacaauugagacgcugaugcuucuggcccucaucgcugugcugaccggcggcguuacacuguuuuuccucucugggaagggacuuggcaaaaccagcauugggcugcugugugugacagccuccucugcccuccuguggauggcuagcguggagccgcacuggaucgcggccuccaucauucuugaauuuuuccugaugguccuccugaucccugagcccgaucggcaacgcaccccucaggacaaccagcuggcuuauguugugauuggacuccuuuuuaugauccugacgguggccgccaacgaaaugggccugcucgagaccacaaagaaagaucuggggauuggacaugucgcugccgagaaucaccaacacgcgaccaugcuugacguggaucugagacccgccagcgcuuggacacucuacgccguugcuaccacggugaucacaccuaugaugcggcauaccaucgaaaacacaaccgccaauauuucucugaccgcgaucgccaaccaggcugccauucugaugggccucgacaagggcuggcccaucuccaaaauggauauuggggucccgcuucuggcucugggaugcuacagccaggugaauccucucacacugacggccgcuguccuuaugcugguggcccacuaugcgaucauuggccccgggcuccaggccaaggcuacccgcgaggcccaaaagagaacagcugccggaaucaugaaaaaccccaccguugacggcaucguggccauugaucuggacccugucguguacgacgcgaaguucgaaaaacagcuggggcagaucaugcuccuuauucuguguacaucucagauccugcucaugcggaccacgugggcucugugcgaguccauuacacuugccaccggaccgcugaccacacucugggaaggcagccccggcaaguuuuggaauaccacaaucgcuguuucuauggccaacaucuuccgcgggagcuaucuggccggagcuggccuggccuucucccucaugaaaucucuugggggaggcagacgggggacgggagcgcaaggcgagacccugggcgagaaguggaagcgccagcugaaucagcucagcaaauccgaauuuaacacauacaagagaagcgggauuauggagguggaucgguccgaagccaaagagggacugaagagaggcgaaaccacaaaacaugcugucucucgcgggaccgccaagcuucggugguucguggagagaaaucuggugaagccugagggaaaaguuaucgaccucggcugugggcgcggaggcuggagcuauuacugcgcuggccugaagaaagucacggaagugaagggguauaccaaaggaggccccgggcacgaggaaccuauucccauggccacauacggauggaaccuggugaagcuccauuccggcaaagaugucuuuuucaugccuccggagaagugugacacccuucugugcgauaucggggaaucuagccccaauccuacaauugaggagggacggacccugagaguucucaagaugguggaacccuggcugcgcggcaaccaguuuuguaucaaaauccuuaauccuuacaugcccuccguggucgagacacuggaacaaaugcagcggaagcacggcgggaugcucgugagaaacccgcugucucgcaauagcacccacgagauguauuggguuuccugcggaacgggcaacauugugagcgcggucaacaugacaucucggaugcugcucaauagauucaccauggcccaucgcaaaccuaccuacgagcgggacguggaucugggggcuggaacaagacacguugccguggaacccgaggucgcuaaccuugacaucauuggccagcgcaucgaaaauauuaagaacgagcauaaauccacguggcacuaugaugaagacaaucccuacaagaccugggccuaucacgggagcuacgaggugaagccuucuggauccgcuagcucuauggugaacggcgucguuagacugcucacaaaacccugggaugugaucccuauggugacccaaauugccaugacagacaccacaccguuuggccagcagcgggucuucaaggagaaaguggacacccgcacgcccagagcgaagcgggggaccacacagaucauggaaguuaccgccaaauggcuguggggauuucuuuccagaaauaagaagccucggaucuguacacgcgaggaauucaccagaaaagugcggagcaacgcugccauuggcgcugucuuuguggaugagaaucaauggaacuccgccaaggaagccguugaggacgagcgcuucugggaucuggugcauagagaacgggagcuccacaaacaggggaagugcgcgacgugcgucuauaauaugaugggaaaacgcgaaaagaagcugggcgaguuugggaaagcuaagggcagcagagccaucugguacauguggcugggagcccgguuccucgaauucgaggcucugggcuuuaugaacgaggaccauugguucucucgcgaaaauagccuuuccgggguggagggagaaggccugcacaaacucggguacauucugagagauaucucuaagauucccggaggcaacauguaugccgacgauacagcugggugggacacccggaucacagaggaugaccuucagaaugaggccaaaaucaccgaaauuauggagccugaacaugcgcugcucgccacgagcaucuuuaagcugaccuaccagaacaaaguugugcgcguccaaagacccgcuaagaacggcacagugauggaugucauuucccggcgcgaccagagaggaucuggccagguggggaccuauggacugaauacauucaccaacauggagguucagcucauccggcaaauggaaagcgagggcauuuuucugccguccgagcuugaaacaccuaaucuggccgagagagugcucgauuggcuggaaaagcacggggcugagcgccuuaaacggauggccaucucuggagacgacugugucgugaagcccaucgaugacagauucgcgaccgcccugacggcucucaacgauaugggcaaagugcgcaaggacauuccucagugggaacccagcaaaggguggaaugauuggcagcagguuccuuuuugcucccaccauuuccaccaacugaucaugaaggacggccgggagauugugguccccuguagaaaccaggaugagcuggugggacgcgcccggguuagccagggcgcuggguggucucucagagaaacagccugccugggaaaguccuacgcucaaauguggcagcuuauguauuuucaucgccgggaccugagacucgccgcgaaugccaucuguagcgcugugccggucgauugggugccuaccucucgcaccacaugguccauucacgcccaccaucaguggaugaccacagaggacaugcugagcgucuggaaccggguguggaucgaagagaaucccuggauggaagauaaaacgcacguuuccucuugggaggaggugcccuaccuuggcaagagagaagaccaguggugcgggagccugaucggacucaccgcccgggcuacaugggccaccaacauucaagucgcgaucaaucaggugagacgccugauuggcaacgagaauuaucuggacuacaugacauccaugaaacgguucaagaacgaaagcgauccugagggggcucucugguga

SEQ ID NO: 18604 - RNA, 9879 nt, Artificial Sequence
  derived and/or modified CDS sequence (opt5) from DENV-1__GQ868503__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccagaacgaaaagggggugacacagaauggaagacucaucacggcuaaccccauugucaccgacaaagagaagccugugaauaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagauacagcgugggacuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaacagccggucuaccucccuuagcaugacauguauugcugugggcauggucacccucuaccugggggugaugguucaagccgauucuggaugcgugaucaacuggaaaggcagagaacugaaguguggguccggaauuuucgucacaaaugaggugcacaccuggacggaacaguauaaguuucaggcugacagcccuaaacgccucuccgccgcgaucggcaaggccugggaggaggggguuugcggcauucggucugcuacaagacuggaaaacaucauguggaaacagaucagcaaugagcuuaaccauauucugcucgaaaaugauaugaaguucaccguggucgugggagacgccaacggcauccuggcucaagggaaaaagaugauucgcccgcagcccauggagcacaaauacuccuggaagucuuggggaaaggccaaaaucauuggcgccgacauccagaauaccacauuuaucauugaugggccugacacccccgaauguccugauaaccagcgggcuuggaauaucugggagguggaggacuauggauucggcauuuuuacgacaaacaucuggcugaagcuuagagauagcuacacccaaaugugcgaccaccgccucauguccgcggccauuaaagauagcaaggcuguccaugccgacaugggcuauuggaucgaaucugagaaaaaugaaacauggaagcuggagcgggccuccuucaucgaaguuaagaccuguacauggcccaaaagccacacccuguggucuaacggggugcucgaguccgagaugauuaucccgaagauuuacggaggcccuaucagccagcauaauuauagacccggguacuucacgcagaccgcuggaccuuggcaccugggcaaacuugaacuggauuuugaccucugcgaggggacaaccguggucguggaugaacacugcggaaaccgcggccccucucugcggacaaccacgguuacaggcaagauuauccaugagugguguugcagaagcuguacccugccuccccuucgguuccgcggggaggacggaugcugguacggcauggaaaucagaccggugaaagagaaggaagagaaucucguccgguccauggugagcgccgggucuggagaaguugauuccuuuagccugggcauucugugugcguccaucaugauugaggaggugaugagaucucgcuggagccggaagaugcucaugacagggacccuggcugucuuccuucugcucaucaugggacaacugaccuggaacgaccugauuagacuuugcaucauggugggcgccaacgccuccgaccgcaugggcauggggacaacguaucuggcucucauggccaccuuuaaaaugagaccuauguucgcgguuggacugcucuuucggcgccugacaucuagagaagugcuucugcucaccauuggccugagccuggucgcuuccguggagcuucccaauucucuggaagagcucggggauggacuggccaugggcaucaugaugcucaagcugcuuacagaauuccagccccaccagcuguggaccacgcuccugagccugacauuuaucaaaaccacccuuucccuggacuacgccuggaagacaaccgcuauggcccucagcauugugucucuguucccucucugucuguccacaacgagccagaaaaccacauggcuuccgguccugcuggggucuuuuggaugcaagccccucaccauguuccugaucacagagaacaagauuuggggccggaaauccuggccucuuaaugagggcaucauggcuauugggaucguuagcauccugcucucuucccugcucaagaacgaugugccccuggccggaccucuuauugcgggcgggaugcugaucgccuguuaugugauuagcggauccagcgcugaccugucucucgaaaaagccgcugaggucagcugggaacaagaggccgaacauuccggcaccucucacaauauccugguggagguucaggaugacgggacgaugaagauuaaagaugaggaacgcgacgauacccuuacaauccugcucaaggccacccugcucgcugugagcggagucuaccccauguccaucccugcgacacuguuugugugguauuucuggcagaaaagaaagcagcggucuggcguucuuugggacacccccagcccgccugagguggaacgcgccguccuggaugacggcauuuacagaauccugcaacgggggcuccugggacgcucccaggugggcgucgggguguuccaggauggaguuuuucauacaauguggcacgugacgagaggcgcuguccuuauguaucaggggaagcggcuggagcccucuugggccagcgugaaaaaggaccucauuuccuacggaggcggcuggagauuccaagggagcuggaacaccggagaggaaguucaggugaucgccgucgagccuggcaaaaaucccaagaacgugcagacaaccccggggauuuuuaaaaccccugaaggagaggugggcgcuaucgcccuggacuucaagcccgggacaucuggauccccuauuguuaaucgcgaaggcaagaucgucggccucuacgggaacggaguggugacgaccagcggcacauaugucucugcgaucgcucaagccaaagccucccaggaggggccccugcccgagauugaagaugagguguuuaagaaacggaaucuuaccaucauggaccugcacccuggaagcggcaagacaagacgcuaccugccggcuauuguucgggaagccaucaaaagaaagcuccgcacccugauucuugcgcccacgcggguggucgcuuccgagauggccgaagcccugaaggggaugccuaucagauaucagacaaccgcugugaaaucugagcauaccggccgcgagaucguugaucucaugugccacgccacauucaccaugcggcugcugagccccgugagagucccuaacuacaauaugauuaucauggacgaagcucauuuuacagaucccgccuccauugcggcccggggauauaucagcacccgcgugggcaugggggaggcugccgcuauuuucaugacggccacaccuccgggaucuguugaagccuuuccccaguccaacgcugugauccaagacgaggaaagagauaucccugagcggagcuggaauucuggcuacgacuggauuaccgauuuccccgggaagacagucugguuugugccuagcaucaaauccggaaacgacauugcgaacugucuccgcaagaauggcaaaagagugauccagcuuucucggaagaccuucgauacggaguaucagaagaccaaaaacaaugacugggacuacgucguuacaaccgauauuagcgaaaugggggccaacuucagagcugaccgcgugaucgauccccggagaugccugaagccggugauucugaaagacggcccugagcgcgucauccucgccggacccaugcccgugacaguugccuccgcugcccagcggagaggccgcaucgggcggaaucaaaacaaggaaggagaucaguacguguauaugggccagccucugaauaacgacgaggaucacgcgcauuggaccgaggcuaaaaugcuucuggacaauauuaacacacccgaagggaucauuccugcccucuuugagccggaaagagagaagucugccgcuaucgauggagaauaccgccugagaggcgaggcccggaagaccuucgucgagcugaugcgcagaggggaccuccccguguggcuuagcuauaaaguugcguccgaaggcuuucaguacagcgaucggcgcuggugcuucgacggagagagaaauaaccaagugcuggaagagaauauggaugucgaaauuuggacgaaggagggcgagcggaaaaagcugagaccucgcuggcucgacgcccggacauauucugacccccuggcucuuagagaauuuaaagaguucgccgcugggcgccgguccgugagcggagaucugauccucgaaaucggcaagcugccucagcaccugacccucagagcccagaacgcucuugacaaucuggucaugcugcacaacuccgagcaggggggaaaagccuaccggcaugcgauggaagagcuccccgauaccauugagacacugaugcuucuggcccucaucgcugugcugaccggcggcguuacacuguuuuuccucucugggaagggacuuggcaagacgagcauugggcugcugugugugaccgccuccucugcucuccuguggauggccagcguggaaccgcacuggaucgccgcuuccauuauccuugaguuuuuccugaugguccuccugaucccugaacccgaccgccaaagaacaccucaggauaaccagcuggcguauguugugauuggacuccuuuuuaugauccugaccguggccgcuaaugagaugggccugcucgagacaaccaaaaaggaccuggggauuggacaugucgccgccgaaaaccaccaacacgcuacgaugcuugauguggaccugcggcccgccagcgcguggacccucuacgccguugcuacaaccgugaucacaccuaugaugcgccauaccauugagaauacgacagccaacaucucucugaccgcuauugccaaucaggcggccauccugaugggccucgauaaaggcuggcccaucuccaagauggacauuggggucccgcuucuggcucugggaugcuacagccaggugaacccucucacacugaccgccgcuguccuuaugcugguggcccacuaugcuaucauuggccccgggcuccaggccaaagcgaccagagaagcccaaaagcggacagcugccggaaucaugaagaaucccacgguugauggcauuguggcuaucgaccuggauccugucguguacgacgccaaauucgagaagcagcuggggcagaucaugcuccuuauucuguguaccucucagauccugcucaugcgcacaaccugggcccugugcgaauccauuacacuugcgaccggaccgcugacgacacucugggagggcagccccggcaaauuuuggaacaccaccaucgcuguuucuauggccaauauuuucagagggagcuaucuggcuggagccggccuggccuucucccucaugaagucucuugggggaggccggcgcgggacaggagcucaaggcgagacccugggcgaaaaauggaagagacagcugaaccagcucagcaaguccgaguuuaauacauacaaacggagcgggaucauggaaguggacagauccgaggccaaggaaggacugaaacgcggcgagacgaccaagcaugcggucucucgggggacagccaaacuuagaugguucguggagcgcaaccuggugaagccugaaggaaagguuaucgaucucggcugugggcggggaggcuggagcuauuacugcgcuggccugaaaaaggucaccgaggugaaaggguauacaaagggaggccccgggcacgaagagccuauucccauggccaccuacggauggaaucuggugaaacuccauuccggcaaggacgucuuuuucaugccuccggaaaaaugugauacgcuucugugcgacaucggggagucuagccccaacccuaccauugaggaaggaagaacacugcgcguucucaagaugguggagcccuggcugcggggcaaucaguuuuguaucaagauucuuaacccuuacaugcccuccguggucgaaacccuggagcaaaugcagagaaaacacggcgggaugcucgugcgcaauccgcugucucggaacagcacacacgagauguauuggguuuccugcggaaccggcaacaucgugagcgcugucaauaugacaucuagaaugcugcucaaccgcuucaccauggcccaucggaagccuacguuugaaagagauguggaccugggggcgggaacacgccacguugccguggagcccgaagucgcuaaucuugauauuaucggccagagaaucgagaacauuaaaaaugaacauaaguccaccuggcacuacgacgaggauaaccccuauaaaaccugggccuaccacgggagcuaugaggugaagccuucuggauccgcuagcucuauggugaauggcgucguucggcugcucacaaagcccugggacgugaucccuauggugacgcaaauugccaugaccgauacaaccccguucggccagcagcgcgucuuuaaagaaaagguggacacaagaaccccccgggcuaaaagagggacaacccagaucauggagguuacggccaaguggcuguggggauuccuuucccggaacaaaaagccucgcauuuguaccagagaagaguuuacacggaaggugcgcagcaaugcggccaucggcgcugucuucguggacgaaaaccaauggaauuccgccaaagaggcuguugaggaugaaagauuuugggaccuggugcaucgggagcgcgaacuccacaagcaggggaaaugcgccaccugcgucuacaacaugaugggaaagagagagaaaaagcugggcgaauucgggaaggccaaaggcagccgggcgaucugguauauguggcugggagcucgcuuccucgaguuugaggcccugggcuucaugaaugaagaucauugguuuucuagagagaacagccuuuccgggguggaaggagagggccugcacaagcucggguacauucugcgggacaucucuaaaauucccggaggcaauauguacgccgaugacacagcugggugggauacccgcaucacggaggacgaucuucagaacgaagccaagauuacagacaucauggagccugaacaugcucugcucgccaccagcaucuucaaacugacauaucagaacaagguugugagaguccaacggcccgcgaaaaauggcaccgugauggaugucauuucccgcagagaccagcggggaucuggccagguggggacguacggacugaacaccuuuacaaauauggagguucagcucaucagacaaauggaaagcgagggcauuuuccugccguccgagcuugaaaccccuaaccuggccgagcgcgugcucgauuggcuggaaaagcacggggcugagcggcuuaagagaauggccaucucuggagacgacugugucgugaaacccauugaugaccgcuuugcuacagcccugaccgcgcucaaugauaugggcaaggugcggaaagacaucccucagugggaacccagcaagggguggaacgauuggcagcagguuccuuucugcucccaccauuuucaccaacugaucaugaaagacggcagagagauugugguccccugucgcaaucaggaugagcuggugggacgggccagaguuagccagggcgcuggguggucucuccgcgaaacagccugccugggaaaguccuaugcucaaauguggcagcuuauguacuuccaucggagagaccugcgccucgccgcuaacgccaucuguagcgcggugccggucgauugggugccuaccucucggacgacaugguccauucacgcccaccaucaguggaugaccaccgaggacaugcugagcgucuggaauagaguguggaucgaagagaaccccuggauggaagauaagacacacguuuccucuugggaggaggugcccuaucuuggcaaacgggaagaccaguggugcgggagccugauuggacucaccgcuagagccacaugggccacgaauauccaagucgcuauuaaccaggugcgccggcugaucggcaaugagaacuaccuggacuauaugaccuccaugaagagauuuaaaaaugaaagcgauccugagggggcccucugguga

SEQ ID NO: 18605 - RNA, 9879 nt, Artificial Sequence
  derived and/or modified CDS sequence (opt5) from DENV-1__GQ868504__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucuguguguguccaucaugauugaagaggucaugagaucucgcuggagccggaagaugcucaugacagggacccuggcuguguuccuucugcucguuaugggacaacugaccuggaaugaccugaucagacuuugcauuauggugggcgccaacgccuccgaucgcaugggcauggggacaacguaucuggcucucauggccaccuuuaaaaugagaccuauguucgcggucggacugcucuuucggcgccugacaucuagagaggugcuucugcucaccaucggccugagccugguggcuuccgucgaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgccuggaagacaaccgcuauggcccucagcaucguuucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggcuaucgggauugugagcauccugcucucuucccugcucaagaaugacgucccccuggccggaccucuuaucgcgggcgggaugcugauugccuguuaugugaucagcggauccagcgcugaucugucucucgagaaagccgcugaaguuagcugggagcaagaagccgagcauuccggcaccucucacaacauucugguggaaguccaggacgaugggacgaugaagaucaaagacgaggagcgcgaugacacccuuacaauucugcucaaggccacccugcucgcugugagcggaguuuaccccauguccaucccugcgacacuguuugugugguauuucuggcagaaaaagaagcagagaucuggcguccuuugggauacccccagcccgccugaaguggagcgggccguccuggacgauggcaucuaccgcauucugcaaagagggcuccugggacggucccaggugggcguugggguguuccaggacggagucuuucauacaauguggcacgugacgcgcggcgcuguucuuauguaucaggggaaaagacuggaacccucuugggccagcgugaagaaagaccucaucuccuacggaggcggcuggcgguuccaagggagcuggaauaccggagaggagguccaggugauugccguggaaccuggcaagaaccccaaaaauguucagacaaccccggggaccuuuaagacaccugagggagaagucggcgcuaucgcccuggauuucaagcccgggacgucuggauccccuauugugaacagagagggcaaaaucgugggccucuacgggaauggagucgugaccacaagcggcaccuauguuucugcgauugcucaagccaaggccucccaggaagggccccugcccgagaucgaggacgaaguguuuaaaaagcgcaaccuuacaaucauggaucugcacccuggaagcggcaaaacccggagauaccugccggcuauuguccgcgaggccaucaagcggaagcucagaacgcugauucuugcgcccacacgcgugguugcuuccgaaauggccgaggcccugaaagggaugccuauccgguaucagaccaccgcugugaagggcgaacauacaggaagagagauugucgaccucaugugccacgccaccuucacaaugcgccugcugucucccgugcggguuccuaauuacaacaugaucaucauggaugaggcucauuuuaccgaccccgccagcauugcggccagaggcuauaucuccacgcggguggggaugggagaagcugccgcuauuuucaugacagccaccccuccgggcagcgucgaggccuuuccccagucuaaugcugugauccaagaugaagagcgcgacauuccugaaagauccuggaacagcggguacgauuggaucacagacuuccccggaaaaaccgugugguuugucccuucuaucaagagcggcaaugauauugcgaacugucuccggaaaaacgggaagcgcguuauccagcuuuccagaaagacguucgacaccgaguaucagaaaacaaagaauaacgacugggauuacguggugaccacagacauuucugagaugggcgccaauuuccgggcugauagagucaucgacccccgccggugccugaaaccggugauucugaaggauggaccugaaagaguuauccucgccggccccaugcccgugaccgucgccagcgcugcccagcgccgggggagaauuggacgcaaccaaaauaaagagggcgaccaguacguguauauggggcagccucugaacaaugaugaagaccacgcgcauuggacagaggcuaagaugcuucuggauaacaucaauacccccgagggaaucauuccugcccucuuugaaccggagcgggaaaaguccgccgcuaucgacggcgaguacagacugcgcggggaagccagaaaaacguucguugagcugaugcggcgcggcgaucuccccguguggcuuucuuauaaggucgcgagcgagggauuucaguacccugacagacgguggugcuucgauggcgaacgcaacaaucaagugcuggaggaaaacauggacgucgagauuuggacaaaagaaggggagagaaagaaacugcggcccagauggcucgacgcccgcaccuauuccgauccucuggcucuucgggaguuuaaggaauucgccgcuggaagacgcagcgugucuggcgaccugauccucgagauugggaaacugccccagcaccugacccuccgggcccagaaugcucuugauaaccugguuaugcugcacaauuccgaacagggaggcaaggccuacagacaugcgauggaggaacucccggacacaaucgagacccugaugcuucuggcccucaucgcugugcugacaggcggggugacgcuguuuuuccucagcggaaagggccuugggaaaaccuccauuggacugcugugugucacagccucuagcgcucuccuguggauggccuccguugagccucacuggaucgccgcuucuauuauccuugaauuuuuccugauggugcuccugauucccgagccugaucggcaacgcaccccccaggacaaccagcuggcguauguggucaucggccuccuuuuuaugauccugacaguggccgcuaacgaaauggggcugcucgagaccacgaagaaagaucugggaauuggccauguugccgccgagaaucaccaacacgcuaccaugcuugacguggaucugagaccugccagcgcguggacacucuacgccgucgcuaccacagugaucacccccaugaugcggcauacgauugaaaacacaaccgccaauaucucccugacagcuauugccaaccaggcggccauccugaugggccucgacaagggguggccgauuagcaaaauggauaucggagucccucuucuggcucugggcugcuacucucaggugaauccccucacccugaccgccgcuguucuuaugcugguggcccacuaugcuaucauugggcccggacuccaggccaaggcgacacgcgaggcccaaaagagaacggcugccggcaucaugaaaaacccuaccgucgacgggauuguggcuaucgaucuggacccgguuguguacgacgccaaguucgaaaaacagcugggacagauuaugcuccuuauccuguguacaucccagauccugcucaugcggaccacaugggcccugugcgagagcauuacccuugcgacgggcccccugacaacccucugggaaggcucuccugggaaguuuuggaauaccacaaucgcugucuccauggccaacauuuuccgcggaagcuaucuggcuggcgccgggcuggccuucucucucaugaaaagccuuggaggcgggagacggggaaccggcgcucaaggcgagacacugggggagaaguggaagcgccagcugaaucagcucuccaaaucugaauuuaacacguacaagagaagcggaaucauggagguggaucgguccgaagccaaagagggccugaagagaggggaaaccacaaaacaugcggugagccgcggaaccgccaagcuucggugguucguugagagaaaucuggucaagcccgagggcaaagugauugaccucggguguggacgcggcggcugguccuauuacugcgcugggcugaagaaagugacagaagucaagggauauaccaaaggcgggccuggacacgaggaacccaucccuauggccacguacggcuggaaccugguuaagcuccauucugggaaagauguguuuuucaugccgcccgagaagugugacacccuucugugcgauaucggagaaagcuccccuaaucccacaauugaggagggccggacccugagagugcucaagauggucgaaccuuggcugcgcggcaaccaguuuuguaucaaaauucuuaaucccuacaugccgucugugguugaggcucuggaacaaaugcagcggaagcacgggggaaugcucgugagaaacccucugagccgcaauuccacacacgagauguauugggucucuugcggcaccgggaacaucgugagcgccguuaacaugacaucccggaugcugcucaauagauucaccauggcgcaucgcaaacccacguacgagcgggacguggaucugggagccggcacaagacacgucgcuguggaacccgagguggccaaccuugacauuaucgggcagcgcauugaaaauaucaagaacgagcauaaaagcaccuggcacuaugaugaagacaauccuuacaagaccugggcuuaucacggaucuuacgaggucaagcccuccggcagcgccucuuccaugguuaacggcguggugagacugcucacaaaaccuugggaugucaucccgauggugacgcaaauugcuaugaccgacacaacccccuuugggcagcagcggguuuucaaggagaaaguggacacacgcaccccuagagccaagcggggaacaacccagaucauggaagucacggcgaaauggcuguggggcuuucuuagcagaaauaagaagccccggauuuguacccgcgaggaauucacaagaaaagugcggucuaacgccgcuaucggggccguuuuuguggaugagaaucaauggaacuccgcuaaggaagccgucgaggacgagcgcuucugggaucuggugcauagagaacgggagcuccacaaacagggaaagugcgccaccugcguuuauaauaugaugggcaaacgcgaaaagaagcugggggaguuuggcaaagcgaagggaagcagagcuauuugguacauguggcugggcgcccgguuccucgaauucgaggcccugggguuuaugaacgaggaccauugguucucccgcgaaaauagccuuucuggaguggagggcgaagggcugcacaaacucggauacauccugagagauaucagcaagauuccuggcgggaacauguaugcugacgauacagccggcugggacacccggaucacggaggaugaccuucagaaugaggcuaaaauuacagaaaucauggagcccgaacaugcccugcucgcgaccuccauuuuuaagcugacauaccagaacaaagucgugcgcguccaaagaccggccaagaacggaaccgugauggauguuaucucucggcgcgaccagagaggcagcgggcaggugggaacguauggccugaauaccuucacaaacauggagguccagcucauccggcaaauggaauccgaggggauuuuucugccuucugagcuugaaacccccaaucuggcugagagagugcucgauuggcuggaaaagcacggagccgagcgccuuaaacggauggcuaucagcggcgacgacugugugguuaagccuauugaugacagauucgccacagcgcugaccgcccucaacgauauggggaaagugcgcaaggacaucccccagugggaaccuuccaaaggcuggaaugauuggcagcagguccccuuuugcucucaccauuuccaccaacugauuaugaaggacggacgggagaucgugguuccguguagaaaccaggaugagcuggugggccgcgcucgggucagccagggggccggauggucccucagagaaacagcuugccugggcaagagcuacgcccaaauguggcagcuuauguauuuucaucgccgggaccugagacucgcugccaaugcgaucuguucugccgugccugucgauugggugcccaccucccgcacgacauggagcauucacgcucaccaucaguggaugaccaccgaggacaugcugucuguuuggaaccggguguggaucgaagagaaucccuggauggaagauaaaacacacgucuccagcugggaggaggugccuuaccuugggaagagagaagaccaguggugcggaucccugauuggccucaccgcccgggccacaugggcuacgaacauccaaguugccauuaaucaggugagacgccugaucgggaacgagaauuaucuggacuacaugaccucuaugaaacgguucaagaacgaaagcgauccggagggcgcgcucugguga

SEQ ID NO: 18606 - RNA, 9879 nt, Artificial Sequence
  derived and/or modified CDS sequence (opt5) from DENV-1__GU131967__SS-prME
agcgugaccaugcugcucaugcugcuucccacagcucuggcuuuccaccucacgaccagaggcggggagccucauaugaucgucuccaagcaggaacggggaaagucucugcuuuuuaagacaagcgcuggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaagcagauucagagaguugaaacaugggcccuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaacaugcgaucaccgccucauguccgcggccauuaaagacagcaaggcuguccaugccgauaugggcuauuggaucgaaucugagaaaaacgaaaccuggaagcuggcccgggcuuccuucaucgagguuaagacauguaccuggcccaaaagccacacgcuguggucuaauggggugcucgaauccgagaugauuaucccgaagauuuacggaggcccuaucagccagcauaacuauagacccggguacuucacccagacagccggaccuuggcaccugggcaaacuugagcuggacuuugaucucugcgaagggaccacaguggucguggacgagcacugcggaaaucgcggccccucucugcggaccacgacaguuaccggcaagauuauccaugaaugguguugcagaagcuguacacugccuccccuucgguuccgcggggaggauggaugcugguacggcauggagaucagaccggugaaagaaaaggaggaaaaccucguccgguccauggugagcgcggggucuggagagguugacuccuuuagccugggcauucuguguguguccaucaugauugaagaggucaugagaucucgcuggagccggaagaugcucaugaccgggacccuggcuguguuccuucugcucguuaugggacaacugacauggaaugaccugaucagacuuugcauuauggugggcgccaacgccuccgaucgcaugggcauggggacgaccuaucuggcucucauggccacauuuaaaaugagaccuauguucgcggucggacugcucuuucggcgccugaccucuagagaggugcuucugcucacaaucggccugagccugguggcuuccgucgaacuucccaacucucuggaggaacucggggacggacuggccaugggcauuaugaugcucaagcugcuuaccgaguuccagccccaccagcuguggacgacacuccugagccugaccuuuaucaaaaccacacuuucccuggauuacgccuggaagaccacagcuauggcccucagcaucguuucucuguucccucucugucuguccacgaccagccagaaaacaaccuggcuuccggugcugcuggggucuuuuggaugcaagccccucacaauguuccugauuaccgaaaauaagaucuggggccggaaauccuggccucuuaacgagggcauuauggcuaucgggauugugagcauccugcucucuucccugcucaagaaugacgucccccuggccggaccucuuaucgcgggcgggaugcugauugccuguuaugugaucagcggauccagcgcugaucugucucucgagaaagccgcugaaguuagcugggagcaagaagccgagcauuccggcacgucucacaacauucugguggaaguccaggacgaugggaccaugaagaucaaagacgaggagcgcgaugacacacuuaccauucugcucaaggccacacugcucgcugugagcggaguuuaccccauguccaucccugcgacccuguuugugugguauuucuggcagaaaaagaagcagagaucuggcguccuuugggauacacccagcccgccugaaguggagcgggccguccuggacgauggcaucuaccgcauucugcaaagagggcuccugggacggucccaggugggcguugggguguuccaggacggagucuuucauacgauguggcacgugacccgcggcgcuguucuuauguaucaggggaaaagacuggaacccucuugggccagcgugaagaaagaccucaucuccuacggaggcggcuggcgguuccaagggagcuggaauacaggagaggagguccaggugauugccguggaaccuggcaagaaccccaaaaauguucagaccaccccggggacauuuaagacgccugagggagaagucggcgcuaucgcccuggauuucaagcccgggaccucuggauccccuauugugaacagagagggcaaaaucgugggccucuacgggaauggagucgugacaaccagcggcacauauguuucugcgauugcucaagccaaggccucccaggaagggccccugcccgagaucgaggacgaaguguuuaaaaagcgcaaccuuaccaucauggaucugcacccuggaagcggcaaaacgcggagauaccugccggcuauuguccgcgaggccaucaagcggaagcucagaacacugauucuugcgcccacccgcgugguugcuuccgaaauggccgaggcccugaaagggaugccuauccgguaucagaccacagcugugaagucugaacauaccggcagagagauugucgaccucaugugccacgccacauucaccaugcgccugcugagccccgugcggguuccuaauuacaacaugaucaucauggaugaggcucauuuuacggaccccgccuccauugcggccagaggauauaucagcacacgggugggcaugggggaagcugccgcuauuuucaugaccgccacaccuccgggaucugucgaggccuuuccccaguccaaugcugugauccaagaugaggaacgcgacauuccugaaagaagcuggaacucuggcuacgauuggaucaccgacuuccccgggaaaacggugugguuugucccuagcaucaaguccggaaaugauauugcgaacugucuccggaaaaacggcaagcgcguuauccagcuuucuagaaagaccuucgacacagaguaucagaaaaccaagaauaacgacugggauuacguggugacaaccgacauuagcgagaugggggccaauuuccgggcugauagagucaucgacccccgccggugccugaaaccggugauucugaaggauggcccugaaagaguuauccucgccggacccaugcccgugacagucgccuccgcugcccagcgccggggcagaauugggcgcaaccaaaauaaagagggagaccaguacguguauaugggccagccucugaacaaugaugaagaccacgcgcauuggaccgaggcuaagaugcuucuggauaacaucaauacgcccgaggggaucauuccugcccucuuugaaccggagcgggaaaagucugccgcuaucgacggagaguacagacugcgcggcgaagccagaaaaacauucguugagcugaugcggcgcggggaucuccccguguggcuuagcuauaaggucgcguccgagggcuuucaguacagcgacagacgguggugcuucgauggagaacgcaacaaucaagugcuggaggaaaacauggacgucgagauuuggaccaaagaaggcgagagaaagaaacugcggccuagauggcucgacgcccgcaccuauucugauccccuggcccuucgggaguuuaaggaguucgccgcugggagacgcuccgugagcggagaccugauccucgagauuggcaaacugccucagcaccugacacuccgggcccagaaugcucuugauaaccugguuaugcugcacaauuccgaacaaggcgggaaggccuacagacaugcgauggaggaacuccccgacaccaucgagacacugaugcuucuggcccucaucgcugugcugaccgggggcgugacgcuguuuuuccucucugggaagggacuuggcaaaacaagcauugggcugcugugugucaccgccuccucugcucuccuguggauggccagcguugagccgcacuggaucgccgcuuccauuauccuugaauuuuuccugauggugcuccugauuccugagcccgaucggcaacgcacaccucaggacaaccagcuggcguauguggucaucggacuccuuuuuaugauccugaccguggccgcuaacgaaaugggccugcucgagacgaccaagaaagaucuggggauuggacauguugccgccgagaaucaccaacacgcuacaaugcuugacguggaucugagacccgccagcgcguggacccucuacgccgucgcuacaaccgugaucacgccuaugaugcggcauacaauugaaaacaccacagccaauaucucucugaccgcuauugccaaccaggcggccauccugaugggccucgacaagggcuggcccauuuccaaaauggauaucggggucccgcuucuggcucugggaugcuacagccaggugaauccucucacccugacagccgcuguucuuaugcugguggcccacuaugcuaucauuggccccgggcuccaggccaaggcgacgcgcgaggcccaaaagagaaccgcugccggaaucaugaaaaaccccacagucgacggcauuguggcuaucgaucuggacccuguuguguacgacgccaaguucgaaaaacagcuggggcagauuaugcuccuuauccuguguaccucucagauccugcucaugcggacaaccugggcccugugcgaguccauuacgcuugcgacaggaccgcugaccacccucugggaaggcagccccggcaaguuuuggaauacaaccaucgcugucucuauggccaacauuuuccgcgggagcuaucuggcuggagccggccuggccuucucccucaugaaaucucuugggggaggcagacgggggacaggagcucaaggcgagacgcugggcgagaaguggaagcgccagcugaaucagcucagcaaauccgaauuuaacaccuacaagagaagcgggaucauggagguggaucgguccgaagccaaagagggacugaagagaggcgaaacaaccaaacaugcggugucucgcgggacagccaaacuucggugguucguugagagaaaucuggucaagccugagggaaaagugauugaccucggcugugggcgcggaggcuggagcuauuacugcgcuggccugaagaaagugaccgaagucaagggguauacgaaaggaggccccgggcacggagagccuaucccccuggccaccuacggcuggaaccucguuaaacuucauuccgggaaagauguguuuuucaugccuccggaaaagugugacacacugcugugcgauaucggagagucuagccccaauccuaccauugaagagggccggacacucagagugcugaagauggucgagcccuggcuucgcggcaaccaguuuuguaucaaaauucugaauccuuacaugcccuccgugguugaagcucucgagcaaaugcagcggaagcacgggggaaugcuggugagaaacccgcugucucgcaauagcacccacgaaauguauugggucuccugcggcacagggaacaucgugagcgccguuaacaugaccucucggaugcuccugaauagauucacgauggcgcaucgcaaaccuacauacgagcgggacguggaucuuggagccggcaccagacacgucgcuguggagcccgaaguggccaaccuggacauuaucgggcagcgcauugagaauaucaagaacgaacauaaauccaccuggcacuaugaugaggacaaucccuacaagacaugggcuuaucacggaagcuacgaagucaagccuucuggcuccgccagcucuaugguuaacggcguggugagacuccugacgaaacccugggaugucaucccuauggugacccaaauugcuaugacagacaccacaccguuugggcagcagcggguuuucaaggagaaaguggacacccgcacacccagagccaagcggggaaccacgcagaucauggaggucaccgcgaaauggcuuuggggcuuucuguccagaaauaagaagccucggauuuguacacgcgaagaguucaccagaaaagugcggagcaacgccgcuaucggggccguuuuuguggaugaaaaucaauggaacuccgcuaaggaggccgucgaagacgagcgcuucugggaucucgugcauagagagcgggaacugcacaaacagggaaagugcgccacaugcguuuauaauaugaugggcaaacgcgagaagaagcugggggaauuuggcaaagcgaagggaagcagagcuauuugguacauguggcucggcgcccgguuccuggaguucgaagcccuuggguuuaugaacgaggaccauugguucucucgcgagaauagccuguccggaguggaaggcgaggggcuccacaaacugggauacauccuuagagauaucucuaagauucccggcgggaacauguaugcugacgauaccgccggcugggacacgcggaucacagaagaugaccugcagaaugaggcuaaaauuaccgagaucauggaaccugagcaugcccuccuggcgacaagcauuuuuaagcugaccuaccagaacaaagucgugcgcguccaaagacccgccaagaacggaacggugauggauguuaucucccggcgcgaccagagaggcucuggacaggugggaaccuauggccucaauacauucaccaacauggaaguccagcugauccggcaaauggagagcgaagggauuuuucuuccguccgagcuggagacaccuaaucucgcugaaagagugcuggauuggcuugagaagcacggagccgaacgccugaaacggauggcuaucucuggcgacgacugugugguuaagcccauugaugacagauucgccaccgcgcucacagcccugaacgauauggggaaagugcgcaaggacaucccucagugggagcccagcaaaggcuggaaugauuggcagcaggucccuuuuugcucccaccauuuccaccaacugauuaugaaggacggacgggaaaucgugguucccuguagaaaccaggaugagcucgugggccgcgcucgggucagccagggggccggauggucucugagagagaccgcuugccuuggcaaguccuacgcccaaauguggcagcugauguauuuucaucgccgggaccucagacuggcugccaaugcgaucuguagcgccgugccggucgauugggugccuacgucucgcacaaccugguccauucacgcucaccaucaguggaugaccacagaagacaugcuuagcguuuggaaccggguguggaucgaggaaaaucccuggauggaggauaaaacccacgucuccucuugggaagaggugcccuaccuggggaagagagaggaccaguggugcggaagccucauuggccugacagcccgggccacgugggcuaccaacauccaaguugccauuaaucaggugagacgccugaucgggaacgaaaauuaucucgacuacaugacauccaugaaacgguucaagaacgagagcgauccugaaggcgcgcugugguga

SEQ ID NO: 18607 - RNA, 9879 nt, Artificial Sequence
  derived and/or modified CDS sequence (opt5) from DENV-1__GU131968__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccagaacgaaaagggggugacacagaauggaagacucaucacggcuaaccccauugucaccgacaaagagaagccugugaauaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagauacagcgugggacuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaacagccggucuaccucccuuagcaugacauguauugcugugggcauggucacccucuaccugggggugaugguucaagccgauucuggaugcgugaucaacuggaaaggcagagaacugaaguguggguccggaauuuucgucacaaaugaggugcacaccuggacggaacaguauaaguuucaggcugacagcccuaaacgccucuccgccgcgaucggcaaggccugggaggaggggguuugcggcauucggucugcuacaagacuggaaaacaucauguggaaacagaucagcaaugagcuuaaccauauucugcucgaaaaugauaugaaguucaccguggucgugggagacgccaacggcauccuggcucaagggaaaaagaugauucgcccgcagcccauggagcacaaauacuccuggaagucuuggggaaaggccaaaaucauuggcgccgacauccagaauaccacauuuaucauugaugggccugacacccccgaauguccugauaaccagcgggcuuggaauaucugggagguggaggacuauggauucggcauuuuuacgacaaacaucuggcugaagcuuagagauagcuacacccaaaugugcgaccaccgccucauguccgcggccauuaaagauagcaaggcuguccaugccgacaugggcuauuggaucgaaucugagaaaaaugaaacauggaagcuggagcgggccuccuucaucgaaguuaagaccuguacauggcccaaaagccacacccuguggucuaacggggugcucgaguccgagaugauuaucccgaagauuuacggaggcccuaucagccagcauaauuauagacccggguacuucacgcagaccgcuggaccuuggcaccugggcaaacuugaacuggauuuugaccucugcgaggggacaaccguggucguggaugaacacugcggaaaccgcggccccucucugcggacaaccacgguuacaggcaagauuauccaugagugguguugcagaagcuguacccugccuccccuucgguuccgcggggaggacggaugcugguacggcauggaaaucagaccggugaaagagaaggaagagaaucucguccgguccauggugagcgccgggucuggagaaguugauuccuuuagccugggcauucugugugcguccaucaugauugaggaggugaugagaucucgcuggagccggaagaugcucaugacagggacccuggcugucuuccuucugcucaucaugggacaacugaccuggaacgaccugauuagacuuugcaucauggugggcgccaacgccuccgaccgcaugggcauggggacaacguaucuggcucucauggccaccuuuaaaaugagaccuauguucgcgguuggacugcucuuucggcgccugacaucuagagaagugcuucugcucaccauuggccugagccuggucgcuuccguggagcuucccaauucucuggaagagcucggggauggacuggccaugggcaucaugaugcucaagcugcuuacagaauuccagccccaccagcuguggaccacgcuccugagccugacauuuaucaaaaccacccuuucccuggacuacgccuggaagacaaccgcuauggcccucagcauugugucucuguucccucucugucuguccacaacgagccagaaaaccacauggcuuccgguccugcuggggucuuuuggaugcaagccccucaccauguuccugaucacagagaacaagauuuggggccggaaauccuggccucuuaaugagggcaucauggcuauugggaucguuagcauccugcucucuucccugcucaagaacgaugugccccuggccggaccucuuauugcgggcgggaugcugaucgccuguuaugugauuagcggauccagcgcugaccugucucucgaaaaagccgcugaggucagcugggaacaagaggccgaacauuccggcaccucucacaauauccugguggagguucaggaugacgggacgaugaagauuaaagaugaggaacgcgacgauacccuuacaauccugcucaaggccacccugcucgcugugagcggagucuaccccauguccaucccugcgacacuguuugugugguauuucuggcagaaaagaaagcagcggucuggcguucuuugggacacccccagcccgccugagguggaacgcgccguccuggaugacggcauuuacagaauccugcaacgggggcuccugggacgcucccaggugggcgucgggguguuccaggauggaguuuuucauacaauguggcacgugacgagaggcgcuguccuuauguaucaggggaagcggcuggagcccucuugggccagcgugaaaaaggaccucauuuccuacggaggcggcuggagauuccaagggagcuggaacaccggagaggaaguucaggugaucgccgucgagccuggcaaaaaucccaagaacgugcagacaaccccggggaccuuuaaaacaccugaaggagaggugggcgcuauugcccuggacuucaagcccgggacgucuggauccccuaucguuaaucgcgaaggcaagauugucggccucuacgggaacggaguggugaccacaagcggcaccuaugucucugcgaucgcucaagccaaagccucccaggaggggccccugcccgagaucgaagaugagguguuuaagaaacggaaucuuacaauuauggaccugcacccuggaagcggcaagaccagacgcuaccugccggcuaucguucgggaagccauuaaaagaaagcuccgcacgcugauccuugcgcccacacggguggucgcuuccgagauggccgaagcccugaaggggaugccuauuagauaucagaccaccgcugugaaaucugagcauacaggccgcgagaucguugaucucaugugccacgccaccuucacaaugcggcugcugagccccgugagagucccuaacuacaauaugaucauuauggacgaagcucauuuuaccgaucccgccuccaucgcggcccggggauauauuagcacgcgcgugggcaugggggaggcugccgcuaucuucaugacagccaccccuccgggaucuguugaagccuuuccccaguccaacgcugugauucaagacgaggaaagagauaucccugagcggagcuggaauucuggcuacgacuggaucacagauuuccccgggaagaccgucugguuugugccuagcauuaaauccggaaacgacaucgcgaacugucuccgcaagaauggcaaaagagugauucagcuuucucggaagacguucgauaccgaguaucagaagacaaaaaacaaugacugggacuacgucguuaccacagauaucagcgaaaugggggccaacuucagagcugaccgcgugauugauccccggagaugccugaagccggugauccugaaagacggcccugagcgcgucauucucgccggacccaugcccgugaccguugccuccgcugcccagcggagaggccgcaucgggcggaaucaaaacaaggaaggagaucaguacguguauaugggccagccucugaauaacgacgaggaucacgcgcauuggacagaggcuaaaaugcuucuggacaauaucaacacccccgaagggauuaucccugcccucuuugagccggaaagagagaagucugccgcuauugauggagaauaccgccugagaggcgaggcccggaagacguucgucgagcugaugcgcagaggggaccuccccguguggcuuagcuauaaaguugcguccgaaggcuuucaguacagcgaucggcgcuggugcuucgacggagagagaaauaaccaagugcuggaagagaauauggaugucgaaaucuggacaaaggagggcgagcggaaaaagcugagaccucgcuggcucgacgcccggaccuauucugacccccuggcucuuagagaauuuaaagaguucgccgcugggcgccgguccgugagcggagaucugauucucgaaaucggcaagcugccucagcaccugacccucagagcccagaacgcucuugacaaucuggucaugcugcacaacuccgagcaggggggaaaagccuaccggcaugcgauggaagagcuccccgauacaaucgagacccugaugcuucuggcccucauugcugugcugacaggcggcguuacgcuguuuuuccucucugggaagggacuuggcaagaccagcaucgggcugcugugugugacagccuccucugcucuccuguggauggccagcguggaaccgcacuggauugccgcuuccaucauucuugaguuuuuccugaugguccuccugaucccugaacccgaccgccaaagaaccccucaggauaaccagcuggcguauguugugaucggacuccuuuuuaugauucugacaguggccgcuaaugagaugggccugcucgagaccacgaaaaaggaccuggggaucggacaugucgccgccgaaaaccaccaacacgcuaccaugcuugauguggaccugcggcccgccagcgcguggacacucuacgccguugcuaccacagugauuaccccuaugaugcgccauacgaucgagaauacaaccgccaacauuucucugacagcuaucgccaaucaggcggccauucugaugggccucgauaaaggcuggcccaucuccaagauggacaucggggucccgcuucuggcucugggaugcuacagccaggugaacccucucacccugaccgccgcuguccuuaugcugguggcccacuaugcuauuaucggccccgggcuccaggccaaagcgacaagagaagcccaaaagcggacggcugccggaauuaugaagaaucccaccguugauggcaucguggcuauugaccuggauccugucguguacgacgccaaauucgagaagcagcuggggcagaucaugcuccuuauccuguguacaucucagauucugcucaugcgcaccacaugggcccugugcgaauccaucacccuugcgacgggaccgcugacaacccucugggagggcagccccggcaaauuuuggaacaccacaauugcuguuucuauggccaauaucuucagagggagcuaucuggcuggagccggccuggccuucucccucaugaagucucuugggggaggccggcgcgggaccggagcucaaggcgagacacugggcgaaaaauggaagagacagcugaaccagcucagcaaguccgaguuuaauacguacaaacggagcgggauuauggaaguggacagauccgaggccaaggaaggacugaaacgcggcgagaccacaaagcaugcggucucucgggggaccgccaaacuuagaugguucguggagcgcaaccuggugaagccugaaggaaagguuaucgaucucggcugugggcggggaggcuggagcuauuacugcgcuggccugaaaaaggucacagaggugaaaggguauaccaagggaggccccgggcacgaagagccuauccccauggccacguacggauggaaucuggugaaacuccauuccggcaaggacgucuuuuucaugccuccggaaaaaugugauacccuucugugcgacauuggggagucuagccccaacccuacaaucgaggaaggaagaacccugcgcguucucaagaugguggagcccuggcugcggggcaaucaguuuuguauuaagauccuuaacccuuacaugcccuccguggucgaaacacuggagcaaaugcagagaaaacacggcgggaugcucgugcgcaauccgcugucucggaacagcacccacgagauguauuggguuuccugcggaacaggcaacauugugagcgcugucaauaugaccucuagaaugcugcucaaccgcuucacgauggcccaucggaagccuacauuugaaagagauguggaccugggggcgggaacccgccacguugccguggagcccgaagucgcuaaucuugauaucauuggccagagaaucgagaacaucaaaaaugaacauaaguccaccuggcacuacgacgaggauaaccccuauaaaacaugggccuaccacgggagcuaugaggugaagccuucuggauccgcuagcucuauggugaauggcgucguucggcugcucacgaagcccugggacgugauuccuauggugacccaaaucgccaugacagauaccacaccguucggccagcagcgcgucuuuaaagaaaagguggacaccagaacaccccgggcuaaaagagggaccacgcagauuauggagguuaccgccaaguggcuguggggauuccuuucccggaacaaaaagccucgcaucuguacaagagaagaguuuacccggaaggugcgcagcaaugcggccauuggcgcugucuucguggacgaaaaccaauggaauuccgccaaagaggcuguugaggaugaaagauuuugggaccuggugcaucgggagcgcgaacuccacaagcaggggaaaugcgccacaugcgucuacaacaugaugggaaagagagagaaaaagcugggcgaauucgggaaggccaaaggcagccgggcgaucugguauauguggcugggagcucgcuuccucgaguuugaggcccugggcuucaugaaugaagaucauugguuuucuagagagaacagccuuuccgggguggaaggagagggccugcacaagcucggguacauccugcgggacauuucuaaaauccccggaggcaauauguacgccgaugacaccgcugggugggauacgcgcauuacagaggacgaucuucagaacgaagccaagaucaccgacauuauggagccugaacaugcucugcucgccacaagcaucuucaaacugaccuaucagaacaagguugugagaguccaacggcccgcgaaaaauggcacggugauggaugucaucucccgcagagaccagcggggaucuggccagguggggaccuacggacugaacacauuuaccaauauggagguucagcucauuagacaaauggaaagcgagggcaucuuccugccguccgagcuugaaacaccuaaccuggccgagcgcgugcucgauuggcuggaaaagcacggggcugagcggcuuaagagaauggccauuucuggagacgacugugucgugaaacccaucgaugaccgcuuugcuaccgcccugacagcgcucaaugauaugggcaaggugcggaaagacauuccucagugggaacccagcaagggguggaacgauuggcagcagguuccuuucugcucccaccauuuucaccaacugaucaugaaagacggcagagagaucgugguccccugucgcaaucaggaugagcuggugggacgggccagaguuagccagggcgcuggguggucucuccgcgaaaccgccugccugggaaaguccuaugcucaaauguggcagcuuauguacuuccaucggagagaccugcgccucgccgcuaacgccauuuguagcgcggugccggucgauugggugccuacgucucggacaaccugguccauccacgcccaccaucaguggaugaccacagaggacaugcugagcgucuggaauagaguguggauugaagagaaccccuggauggaagauaagacccacguuuccucuugggaggaggugcccuaucuuggcaaacgggaagaccaguggugcgggagccugaucggacucacagcuagagccacgugggccaccaauauucaagucgcuaucaaccaggugcgccggcugauuggcaaugagaacuaccuggacuauaugacauccaugaagagauuuaaaaaugaaagcgauccugagggggcccucugguga
